United States Patent 12,508,308 (INFLUENZA mRNA VACCINES) - sequence listing, part 20

SEQ ID NO: 71745 - RNA, 1701 nt, Artificial Sequence
  derived and/or modified sequence opt1 from hemagglutinin__InfluenzaA__AHC60107
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagaucaucgacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaacaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacgucuaccgggacgaggcccugaacaaccgcuucaagaucaaggggguggagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 71746 - RNA, 1701 nt, Artificial Sequence; identical to SEQ ID NO: 67990
  derived and/or modified sequence opt1 from hemagglutinin__InfluenzaA__AHC60119

SEQ ID NO: 71747 - RNA, 1701 nt, Artificial Sequence; identical to SEQ ID NO: 67990
  derived and/or modified sequence opt1 from hemagglutinin__InfluenzaA__AHC60131

SEQ ID NO: 71748 - RNA, 1701 nt, Artificial Sequence; identical to SEQ ID NO: 71656
  derived and/or modified sequence opt1 from hemagglutinin__InfluenzaA__AHC60143

SEQ ID NO: 71749 - RNA, 1701 nt, Artificial Sequence
  derived and/or modified sequence opt1 from hemagglutinin__InfluenzaA__AHC60155
augaagaccgugaucgcccugagcuacauccucugccuggccuucgcgcagaagcugcccggcaacgacaacuccaccgccacgcucugccuggggcaccacgccgucccgaacggcaccaucgugaagaccaucaccaacgaccagaucgaggugacgaacgccaccgagcugguccagagcucccccaccggggagaucugcgacagcccccaccagauccucgacggcgagaacugcacccugaucgacgcccugcucggggacccccagugcgacggcuuccagaacaagaagugggaccuguucguggagcgcuccaaggcguacagcaacugcuacccguacgacgugcccgacuacgccucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcgcugaacgugaccaugcccaacaacgagcaguucgacaagcucuacaucuggggcguccaccacccggggaccgacaaggaccagaucuuccuguacgcccaggccuccgggcggaucaccgugagcacgaagcgcucccagcaggccgugauccccaacaucggcagccggccccgcguccggaacauccccagccgcaucuccaucuacuggaccaucgugaagccgggcgacauccugcucaucaacagcaccgggaaccugaucgcgccccggggcuacuucaagauccgcuccggcaagagcuccaucaugcggagcgacgcccccaucgggaagugcaacuccgagugcaucacccccaacggcagcaucccgaacgacaagcccuuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 71750 - RNA, 1701 nt, Artificial Sequence; identical to SEQ ID NO: 67863
  derived and/or modified sequence opt1 from hemagglutinin__InfluenzaA__AHC60167

SEQ ID NO: 71751 - RNA, 1701 nt, Artificial Sequence; identical to SEQ ID NO: 68790
  derived and/or modified sequence opt1 from hemagglutinin__InfluenzaA__AHC60179

SEQ ID NO: 71752 - RNA, 1701 nt, Artificial Sequence; identical to SEQ ID NO: 71701
  derived and/or modified sequence opt1 from hemagglutinin__InfluenzaA__AHC60191

SEQ ID NO: 71753 - RNA, 1701 nt, Artificial Sequence; identical to SEQ ID NO: 71701
  derived and/or modified sequence opt1 from hemagglutinin__InfluenzaA__AHC60203

SEQ ID NO: 71754 - RNA, 1701 nt, Artificial Sequence; identical to SEQ ID NO: 70082
  derived and/or modified sequence opt1 from hemagglutinin__InfluenzaA__AHC60215

SEQ ID NO: 71755 - RNA, 1701 nt, Artificial Sequence; identical to SEQ ID NO: 68790
  derived and/or modified sequence opt1 from hemagglutinin__InfluenzaA__AHC60239

SEQ ID NO: 71756 - RNA, 1701 nt, Artificial Sequence; identical to SEQ ID NO: 68790
  derived and/or modified sequence opt1 from hemagglutinin__InfluenzaA__AHC60251

SEQ ID NO: 71757 - RNA, 1701 nt, Artificial Sequence
  derived and/or modified sequence opt1 from hemagglutinin__InfluenzaA__AHC60263
augaagaccaucaucgcccugagcuacauccucugccugguguucgcccagaagcugcccggcaacgagaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 71758 - RNA, 1701 nt, Artificial Sequence; identical to SEQ ID NO: 67863
  derived and/or modified sequence opt1 from hemagglutinin__InfluenzaA__AHC60275

SEQ ID NO: 71759 - RNA, 1701 nt, Artificial Sequence; identical to SEQ ID NO: 71745
  derived and/or modified sequence opt1 from hemagglutinin__InfluenzaA__AHC60287

SEQ ID NO: 71760 - RNA, 1701 nt, Artificial Sequence; identical to SEQ ID NO: 71626
  derived and/or modified sequence opt1 from hemagglutinin__InfluenzaA__AHC60299

SEQ ID NO: 71761 - RNA, 1701 nt, Artificial Sequence
  derived and/or modified sequence opt1 from hemagglutinin__InfluenzaA__AHC60311
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucgacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 71762 - RNA, 1701 nt, Artificial Sequence; identical to SEQ ID NO: 68790
  derived and/or modified sequence opt1 from hemagglutinin__InfluenzaA__AHC60323

SEQ ID NO: 71763 - RNA, 1701 nt, Artificial Sequence; identical to SEQ ID NO: 70082
  derived and/or modified sequence opt1 from hemagglutinin__InfluenzaA__AHC60335

SEQ ID NO: 71764 - RNA, 1701 nt, Artificial Sequence; identical to SEQ ID NO: 67863
  derived and/or modified sequence opt1 from hemagglutinin__InfluenzaA__AHC60347

SEQ ID NO: 71765 - RNA, 1701 nt, Artificial Sequence; identical to SEQ ID NO: 67990
  derived and/or modified sequence opt1 from hemagglutinin__InfluenzaA__AHC60359

SEQ ID NO: 71766 - RNA, 1701 nt, Artificial Sequence; identical to SEQ ID NO: 71687
  derived and/or modified sequence opt1 from hemagglutinin__InfluenzaA__AHC60371

SEQ ID NO: 71767 - RNA, 1701 nt, Artificial Sequence; identical to SEQ ID NO: 67863
  derived and/or modified sequence opt1 from hemagglutinin__InfluenzaA__AHC60383

SEQ ID NO: 71768 - RNA, 1701 nt, Artificial Sequence; identical to SEQ ID NO: 67990
  derived and/or modified sequence opt1 from hemagglutinin__InfluenzaA__AHC60395

SEQ ID NO: 71769 - RNA, 1701 nt, Artificial Sequence; identical to SEQ ID NO: 71701
  derived and/or modified sequence opt1 from hemagglutinin__InfluenzaA__AHC60407

SEQ ID NO: 71770 - RNA, 1701 nt, Artificial Sequence; identical to SEQ ID NO: 67863
  derived and/or modified sequence opt1 from hemagglutinin__InfluenzaA__AHC60419

SEQ ID NO: 71771 - RNA, 1701 nt, Artificial Sequence; identical to SEQ ID NO: 67990
  derived and/or modified sequence opt1 from hemagglutinin__InfluenzaA__AHC60431

SEQ ID NO: 71772 - RNA, 1701 nt, Artificial Sequence; identical to SEQ ID NO: 67863
  derived and/or modified sequence opt1 from hemagglutinin__InfluenzaA__AHC60455

SEQ ID NO: 71773 - RNA, 1701 nt, Artificial Sequence; identical to SEQ ID NO: 67863
  derived and/or modified sequence opt1 from hemagglutinin__InfluenzaA__AHC60467

SEQ ID NO: 71774 - RNA, 1701 nt, Artificial Sequence; identical to SEQ ID NO: 71625
  derived and/or modified sequence opt1 from hemagglutinin__InfluenzaA__AHC60479

SEQ ID NO: 71775 - RNA, 1701 nt, Artificial Sequence; identical to SEQ ID NO: 68790
  derived and/or modified sequence opt1 from hemagglutinin__InfluenzaA__AHC60491

SEQ ID NO: 71776 - RNA, 1701 nt, Artificial Sequence
  derived and/or modified sequence opt1 from hemagglutinin__InfluenzaA__AHC60503
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggcgugccagaaggggaacauccggugcaacaucugcaucuga

SEQ ID NO: 71777 - RNA, 1701 nt, Artificial Sequence; identical to SEQ ID NO: 67990
  derived and/or modified sequence opt1 from hemagglutinin__InfluenzaA__AHC60515

SEQ ID NO: 71778 - RNA, 1701 nt, Artificial Sequence; identical to SEQ ID NO: 68790
  derived and/or modified sequence opt1 from hemagglutinin__InfluenzaA__AHC60527

SEQ ID NO: 71779 - RNA, 1701 nt, Artificial Sequence; identical to SEQ ID NO: 67990
  derived and/or modified sequence opt1 from hemagglutinin__InfluenzaA__AHC60539

SEQ ID NO: 71780 - RNA, 1701 nt, Artificial Sequence; identical to SEQ ID NO: 71637
  derived and/or modified sequence opt1 from hemagglutinin__InfluenzaA__AHC60551

SEQ ID NO: 71781 - RNA, 1701 nt, Artificial Sequence; identical to SEQ ID NO: 70082
  derived and/or modified sequence opt1 from hemagglutinin__InfluenzaA__AHC60563

SEQ ID NO: 71782 - RNA, 1701 nt, Artificial Sequence; identical to SEQ ID NO: 70082
  derived and/or modified sequence opt1 from hemagglutinin__InfluenzaA__AHC60575

SEQ ID NO: 71783 - RNA, 1701 nt, Artificial Sequence
  derived and/or modified sequence opt1 from hemagglutinin__InfluenzaA__AHC60587
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccagaaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 71784 - RNA, 1701 nt, Artificial Sequence; identical to SEQ ID NO: 70082
  derived and/or modified sequence opt1 from hemagglutinin__InfluenzaA__AHC60599

SEQ ID NO: 71785 - RNA, 1701 nt, Artificial Sequence; identical to SEQ ID NO: 67863
  derived and/or modified sequence opt1 from hemagglutinin__InfluenzaA__AHC60611

SEQ ID NO: 71786 - RNA, 1701 nt, Artificial Sequence
  derived and/or modified sequence opt1 from hemagglutinin__InfluenzaA__AHC60623
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcaacgggaaguccuccaucaugcggagcgacgcccccaucggcaagugcaacuccgagugcaucacccccaacggcagcauccccaacgacaagccguuccagaacgugaaccgcaucacguacggggccugcccccgguacgugaagcaguccacccugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 71787 - RNA, 1701 nt, Artificial Sequence; identical to SEQ ID NO: 70082
  derived and/or modified sequence opt1 from hemagglutinin__InfluenzaA__AHC60635

SEQ ID NO: 71788 - RNA, 1701 nt, Artificial Sequence
  derived and/or modified sequence opt1 from hemagglutinin__InfluenzaA__AHC60647
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagaacagcuccaccggggagaucugcgacagcccccaccagauccucgacggcgagaacugcacgcugaucgacgcccugcucggggacccccagugcgacggcuuccagaacaagaagugggaccuguucguggagcgcuccaaggccuacagcaacugcuaccccuacgacgugccggacuacgccucccugcggagccucgucgcguccagcggcacccuggaguucaacaacgaguccuucaacuggaccggggugacccagaacggcacgagcuccgccugcauccgccggagcaacaacuccuucuucagccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcguccgggcggaucacggugagcaccaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 71789 - RNA, 1701 nt, Artificial Sequence
  derived and/or modified sequence opt1 from hemagglutinin__InfluenzaA__AHC60659
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcaacagcccccaccagauccucgacggcgagaacugcacgcugaucgacgcccugcucggggacccccagugcgacggcuuccagaacaagaagugggaccuguucguggagcgcagcaaggcccacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcggccgggcggaucacggugagcaccaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgcgugcaucacgcccaacggcagcauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggcggggccaggcggccgaccucaagagcacccaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 71790 - RNA, 1701 nt, Artificial Sequence
  derived and/or modified sequence opt1 from hemagglutinin__InfluenzaA__AHC60671
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaaggagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 71791 - RNA, 1701 nt, Artificial Sequence
  derived and/or modified sequence opt1 from hemagglutinin__InfluenzaA__AHC60683
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucauccggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 71792 - RNA, 1701 nt, Artificial Sequence
  derived and/or modified sequence opt1 from hemagglutinin__InfluenzaA__AHC60695
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcaugcgcggguccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgugaucccgaacaucggcagccgcccccggguccgcaacauccccucccgggugagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcguggagcugaaguccggcuacaaggacuggauccuguggaucuccuucgccaucagcugcuuccuccugugcgucgcgcugcucggguucaucaugugggccugccagaagggcaacauccgcugcaacaucugcaucuga

SEQ ID NO: 71793 - RNA, 1701 nt, Artificial Sequence
  derived and/or modified sequence opt1 from hemagglutinin__InfluenzaA__AHC60707
augaagaccaucaucgcccugagcuacauccucugccugguguucgcccagaagcugcccggcaacgacaacuccaccgcgacgcucugccuggggcaccacgccgucccgaacggcaccaucgugaagaccaucaccgacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggaucaucuggaucagcuucgccaucuccugcuuccugcucugcguggcccugcugggcuucaucaugugggcgugccagaaggggaacauccggugcaacaucugcaucuga

SEQ ID NO: 71794 - RNA, 1701 nt, Artificial Sequence; identical to SEQ ID NO: 67863
  derived and/or modified sequence opt1 from hemagglutinin__InfluenzaA__AHC60719

SEQ ID NO: 71795 - RNA, 1701 nt, Artificial Sequence; identical to SEQ ID NO: 67990
  derived and/or modified sequence opt1 from hemagglutinin__InfluenzaA__AHC60731

SEQ ID NO: 71796 - RNA, 1701 nt, Artificial Sequence; identical to SEQ ID NO: 71701
  derived and/or modified sequence opt1 from hemagglutinin__InfluenzaA__AHC60743

SEQ ID NO: 71797 - RNA, 1701 nt, Artificial Sequence; identical to SEQ ID NO: 64419
  derived and/or modified sequence opt1 from hemagglutinin__InfluenzaA__AHC60767

SEQ ID NO: 71798 - RNA, 1701 nt, Artificial Sequence
  derived and/or modified sequence opt1 from hemagglutinin__InfluenzaA__AHC60779
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagcgcuucaacuggaccggggugacccagaacggcaccagcuccgccugcauccggcgcagcaacaacuccuucuucagccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcgcaucaccguguccacgaagcggagccagcaggccgugaucccgaacaucggcucccgcccccggguccgcaacauccccagccgggugagcaucuacuggaccaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgccugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgcgggguucaucgagaacggcugggagggcauggucgacgggugguacggcuuccggcaccagaacagcgaggggcgcggccaggccgccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgcgaucagcugcuuccuccugugcgucgcccugcucggcuucaucaugugggccugccagaaggggaacauccgcugcaacaucugcaucuga

SEQ ID NO: 71799 - RNA, 1701 nt, Artificial Sequence; identical to SEQ ID NO: 67990
  derived and/or modified sequence opt1 from hemagglutinin__InfluenzaA__AHC60791

SEQ ID NO: 71800 - RNA, 1701 nt, Artificial Sequence; identical to SEQ ID NO: 71659
  derived and/or modified sequence opt1 from hemagglutinin__InfluenzaA__AHC60803

SEQ ID NO: 71801 - RNA, 1701 nt, Artificial Sequence; identical to SEQ ID NO: 67863
  derived and/or modified sequence opt1 from hemagglutinin__InfluenzaA__AHC60815

SEQ ID NO: 71802 - RNA, 1701 nt, Artificial Sequence
  derived and/or modified sequence opt1 from hemagglutinin__InfluenzaA__AHC60827
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgacgagaucugcaacagcccccaccagauccucgacggggagaacugcacccugaucgacgcccugcucggcgacccccagugcgacggguuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggcgugacccagaacgggaccuccagcgccugcauccgcggcuccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggagccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 71803 - RNA, 1701 nt, Artificial Sequence; identical to SEQ ID NO: 71637
  derived and/or modified sequence opt1 from hemagglutinin__InfluenzaA__AHC60839

SEQ ID NO: 71804 - RNA, 1701 nt, Artificial Sequence; identical to SEQ ID NO: 67990
  derived and/or modified sequence opt1 from hemagglutinin__InfluenzaA__AHC60851

SEQ ID NO: 71805 - RNA, 1701 nt, Artificial Sequence
  derived and/or modified sequence opt1 from hemagglutinin__InfluenzaA__AHC60863
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaggcgggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 71806 - RNA, 1701 nt, Artificial Sequence; identical to SEQ ID NO: 67990
  derived and/or modified sequence opt1 from hemagglutinin__InfluenzaA__AHC60875

SEQ ID NO: 71807 - RNA, 1701 nt, Artificial Sequence; identical to SEQ ID NO: 67990
  derived and/or modified sequence opt1 from hemagglutinin__InfluenzaA__AHC60887

SEQ ID NO: 71808 - RNA, 1701 nt, Artificial Sequence; identical to SEQ ID NO: 64419
  derived and/or modified sequence opt1 from hemagglutinin__InfluenzaA__AHC60899

SEQ ID NO: 71809 - RNA, 1701 nt, Artificial Sequence; identical to SEQ ID NO: 68790
  derived and/or modified sequence opt1 from hemagglutinin__InfluenzaA__AHC60911

SEQ ID NO: 71810 - RNA, 1701 nt, Artificial Sequence; identical to SEQ ID NO: 71626
  derived and/or modified sequence opt1 from hemagglutinin__InfluenzaA__AHC60923

SEQ ID NO: 71811 - RNA, 1701 nt, Artificial Sequence; identical to SEQ ID NO: 68790
  derived and/or modified sequence opt1 from hemagglutinin__InfluenzaA__AHC60935

SEQ ID NO: 71812 - RNA, 1701 nt, Artificial Sequence; identical to SEQ ID NO: 67990
  derived and/or modified sequence opt1 from hemagglutinin__InfluenzaA__AHC60947

SEQ ID NO: 71813 - RNA, 1701 nt, Artificial Sequence; identical to SEQ ID NO: 68790
  derived and/or modified sequence opt1 from hemagglutinin__InfluenzaA__AHC60959

SEQ ID NO: 71814 - RNA, 1701 nt, Artificial Sequence; identical to SEQ ID NO: 67863
  derived and/or modified sequence opt1 from hemagglutinin__InfluenzaA__AHC60971

SEQ ID NO: 71815 - RNA, 1701 nt, Artificial Sequence; identical to SEQ ID NO: 68790
  derived and/or modified sequence opt1 from hemagglutinin__InfluenzaA__AHC60983

SEQ ID NO: 71816 - RNA, 1701 nt, Artificial Sequence; identical to SEQ ID NO: 67990
  derived and/or modified sequence opt1 from hemagglutinin__InfluenzaA__AHC61007

SEQ ID NO: 71817 - RNA, 1701 nt, Artificial Sequence; identical to SEQ ID NO: 67863
  derived and/or modified sequence opt1 from hemagglutinin__InfluenzaA__AHC61019

SEQ ID NO: 71818 - RNA, 1701 nt, Artificial Sequence
  derived and/or modified sequence opt1 from hemagglutinin__InfluenzaA__AHC61031
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgugcugcucggcuucaucaugugggccugccagaaggggaacauccggugcaacaucugcaucuga

SEQ ID NO: 71819 - RNA, 1701 nt, Artificial Sequence; identical to SEQ ID NO: 68790
  derived and/or modified sequence opt1 from hemagglutinin__InfluenzaA__AHC61043

SEQ ID NO: 71820 - RNA, 1701 nt, Artificial Sequence
  derived and/or modified sequence opt1 from hemagglutinin__InfluenzaA__AHC61055
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccagaaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 71821 - RNA, 1701 nt, Artificial Sequence; identical to SEQ ID NO: 71687
  derived and/or modified sequence opt1 from hemagglutinin__InfluenzaA__AHC61067

SEQ ID NO: 71822 - RNA, 1701 nt, Artificial Sequence; identical to SEQ ID NO: 70082
  derived and/or modified sequence opt1 from hemagglutinin__InfluenzaA__AHC61079

SEQ ID NO: 71823 - RNA, 1701 nt, Artificial Sequence; identical to SEQ ID NO: 67990
  derived and/or modified sequence opt1 from hemagglutinin__InfluenzaA__AHC61103

SEQ ID NO: 71824 - RNA, 1701 nt, Artificial Sequence; identical to SEQ ID NO: 67990
  derived and/or modified sequence opt1 from hemagglutinin__InfluenzaA__AHC61115

SEQ ID NO: 71825 - RNA, 1701 nt, Artificial Sequence; identical to SEQ ID NO: 68790
  derived and/or modified sequence opt1 from hemagglutinin__InfluenzaA__AHC61127

SEQ ID NO: 71826 - RNA, 1701 nt, Artificial Sequence
  derived and/or modified sequence opt1 from hemagglutinin__InfluenzaA__AHC61139
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgcagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacaaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 71827 - RNA, 1701 nt, Artificial Sequence; identical to SEQ ID NO: 67990
  derived and/or modified sequence opt1 from hemagglutinin__InfluenzaA__AHC61151

SEQ ID NO: 71828 - RNA, 1701 nt, Artificial Sequence
  derived and/or modified sequence opt1 from hemagglutinin__InfluenzaA__AHC61163
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaagaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccguggucccgaacaucggcagccggccccgcgugcggaacauccccucccgcgugagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 71829 - RNA, 1701 nt, Artificial Sequence; identical to SEQ ID NO: 68790
  derived and/or modified sequence opt1 from hemagglutinin__InfluenzaA__AHC61175

SEQ ID NO: 71830 - RNA, 1701 nt, Artificial Sequence; identical to SEQ ID NO: 67990
  derived and/or modified sequence opt1 from hemagglutinin__InfluenzaA__AHC61187

SEQ ID NO: 71831 - RNA, 1701 nt, Artificial Sequence; identical to SEQ ID NO: 67863
  derived and/or modified sequence opt1 from hemagglutinin__InfluenzaA__AHC61199

SEQ ID NO: 71832 - RNA, 1701 nt, Artificial Sequence; identical to SEQ ID NO: 71626
  derived and/or modified sequence opt1 from hemagglutinin__InfluenzaA__AHC61211

SEQ ID NO: 71833 - RNA, 1701 nt, Artificial Sequence; identical to SEQ ID NO: 67863
  derived and/or modified sequence opt1 from hemagglutinin__InfluenzaA__AHC61223

SEQ ID NO: 71834 - RNA, 1701 nt, Artificial Sequence; identical to SEQ ID NO: 67990
  derived and/or modified sequence opt1 from hemagglutinin__InfluenzaA__AHC61235

SEQ ID NO: 71835 - RNA, 1701 nt, Artificial Sequence; identical to SEQ ID NO: 68790
  derived and/or modified sequence opt1 from hemagglutinin__InfluenzaA__AHC61247

SEQ ID NO: 71836 - RNA, 1701 nt, Artificial Sequence; identical to SEQ ID NO: 68790
  derived and/or modified sequence opt1 from hemagglutinin__InfluenzaA__AHC61259

SEQ ID NO: 71837 - RNA, 1701 nt, Artificial Sequence; identical to SEQ ID NO: 67990
  derived and/or modified sequence opt1 from hemagglutinin__InfluenzaA__AHC61271

SEQ ID NO: 71838 - RNA, 1701 nt, Artificial Sequence; identical to SEQ ID NO: 67863
  derived and/or modified sequence opt1 from hemagglutinin__InfluenzaA__AHC61283

SEQ ID NO: 71839 - RNA, 1701 nt, Artificial Sequence; identical to SEQ ID NO: 70082
  derived and/or modified sequence opt1 from hemagglutinin__InfluenzaA__AHC61295

SEQ ID NO: 71840 - RNA, 1701 nt, Artificial Sequence; identical to SEQ ID NO: 71694
  derived and/or modified sequence opt1 from hemagglutinin__InfluenzaA__AHC61307

SEQ ID NO: 71841 - RNA, 1701 nt, Artificial Sequence; identical to SEQ ID NO: 67990
  derived and/or modified sequence opt1 from hemagglutinin__InfluenzaA__AHC61319

SEQ ID NO: 71842 - RNA, 1701 nt, Artificial Sequence; identical to SEQ ID NO: 71626
  derived and/or modified sequence opt1 from hemagglutinin__InfluenzaA__AHC61331

SEQ ID NO: 71843 - RNA, 1701 nt, Artificial Sequence
  derived and/or modified sequence opt1 from hemagglutinin__InfluenzaA__AHC61343
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcggguccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgugaucccgaacaucggcagccgcccccggguccgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgcgugcaucacccccaacggguccauccccaacgacaagccguuccagaacgugaaccggaucacguacggcgccugcccccgcuacgucaagcagaacacccugaagcucgccaccgggaugcggaacgugcccgagaagcagacccgcggcaucuucggggccaucgccggcuucaucgagaacggcugggaggggaugguggacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcgcugcucggguucaucaugugggccugccagaagggcaacauccgcugcaacaucugcaucuga

SEQ ID NO: 71844 - RNA, 1701 nt, Artificial Sequence; identical to SEQ ID NO: 67863
  derived and/or modified sequence opt1 from hemagglutinin__InfluenzaA__AHC61355

SEQ ID NO: 71845 - RNA, 1701 nt, Artificial Sequence; identical to SEQ ID NO: 67863
  derived and/or modified sequence opt1 from hemagglutinin__InfluenzaA__AHC61367

SEQ ID NO: 71846 - RNA, 1701 nt, Artificial Sequence; identical to SEQ ID NO: 67990
  derived and/or modified sequence opt1 from hemagglutinin__InfluenzaA__AHC61379

SEQ ID NO: 71847 - RNA, 1701 nt, Artificial Sequence; identical to SEQ ID NO: 67863
  derived and/or modified sequence opt1 from hemagglutinin__InfluenzaA__AHC61391

SEQ ID NO: 71848 - RNA, 1701 nt, Artificial Sequence
  derived and/or modified sequence opt1 from hemagglutinin__InfluenzaA__AHC61403
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcagccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 71849 - RNA, 1701 nt, Artificial Sequence; identical to SEQ ID NO: 67990
  derived and/or modified sequence opt1 from hemagglutinin__InfluenzaA__AHC61415

SEQ ID NO: 71850 - RNA, 1701 nt, Artificial Sequence
  derived and/or modified sequence opt1 from hemagglutinin__InfluenzaA__AHC61427
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaacaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucauccggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 71851 - RNA, 1701 nt, Artificial Sequence
  derived and/or modified sequence opt1 from hemagglutinin__InfluenzaA__AHC61439
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccacgugcaucacccccaacggcagcauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggcggggccaggcggccgaccucaagagcacccaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 71852 - RNA, 1701 nt, Artificial Sequence; identical to SEQ ID NO: 67863
  derived and/or modified sequence opt1 from hemagglutinin__InfluenzaA__AHC61451

SEQ ID NO: 71853 - RNA, 1701 nt, Artificial Sequence; identical to SEQ ID NO: 67863
  derived and/or modified sequence opt1 from hemagglutinin__InfluenzaA__AHC61463

SEQ ID NO: 71854 - RNA, 1701 nt, Artificial Sequence; identical to SEQ ID NO: 68790
  derived and/or modified sequence opt1 from hemagglutinin__InfluenzaA__AHC61475

SEQ ID NO: 71855 - RNA, 1701 nt, Artificial Sequence; identical to SEQ ID NO: 67990
  derived and/or modified sequence opt1 from hemagglutinin__InfluenzaA__AHC61487

SEQ ID NO: 71856 - RNA, 1701 nt, Artificial Sequence; identical to SEQ ID NO: 68790
  derived and/or modified sequence opt1 from hemagglutinin__InfluenzaA__AHC61499

SEQ ID NO: 71857 - RNA, 1701 nt, Artificial Sequence; identical to SEQ ID NO: 67863
  derived and/or modified sequence opt1 from hemagglutinin__InfluenzaA__AHC61511

SEQ ID NO: 71858 - RNA, 1701 nt, Artificial Sequence; identical to SEQ ID NO: 70082
  derived and/or modified sequence opt1 from hemagglutinin__InfluenzaA__AHC61523

SEQ ID NO: 71859 - RNA, 1701 nt, Artificial Sequence
  derived and/or modified sequence opt1 from hemagglutinin__InfluenzaA__AHC61535
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaccaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 71860 - RNA, 1701 nt, Artificial Sequence; identical to SEQ ID NO: 67863
  derived and/or modified sequence opt1 from hemagglutinin__InfluenzaA__AHC61547

SEQ ID NO: 71861 - RNA, 1701 nt, Artificial Sequence
  derived and/or modified sequence opt1 from hemagglutinin__InfluenzaA__AHC61559
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagaucaucgacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaacaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugauccggaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacaugggcaacgggugcuucaagaucuaccacaagugcgacaacgccugcaucggcagcauccggaacgggaccuacgaccacgacgucuaccgcgacgaggcccugaacaaccgguuccagaucaagggcguggagcucaaguccgggcacaaggacuggauccuguggaucagcuucgccaucuccugcuuccugcucugcguggcccugcugggcuucaucaugugggcgugccagaagggcaacauccgcugcaacaucugcaucuga

SEQ ID NO: 71862 - RNA, 1701 nt, Artificial Sequence; identical to SEQ ID NO: 70082
  derived and/or modified sequence opt1 from hemagglutinin__InfluenzaA__AHC61571

SEQ ID NO: 71863 - RNA, 1701 nt, Artificial Sequence; identical to SEQ ID NO: 67863
  derived and/or modified sequence opt1 from hemagglutinin__InfluenzaA__AHC61583

SEQ ID NO: 71864 - RNA, 1701 nt, Artificial Sequence; identical to SEQ ID NO: 70082
  derived and/or modified sequence opt1 from hemagglutinin__InfluenzaA__AHC61595

SEQ ID NO: 71865 - RNA, 1701 nt, Artificial Sequence
  derived and/or modified sequence opt1 from hemagglutinin__InfluenzaA__AHC61607
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagcacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 71866 - RNA, 1701 nt, Artificial Sequence; identical to SEQ ID NO: 70082
  derived and/or modified sequence opt1 from hemagglutinin__InfluenzaA__AHC61619

SEQ ID NO: 71867 - RNA, 1701 nt, Artificial Sequence
  derived and/or modified sequence opt1 from hemagglutinin__InfluenzaA__AHC61631
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcaccaucaucgacgcccugcugggggacccccagugcgacggcuuccagaacaagaagugggaccucuucguggagcgcagcaaggcccacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcugaucaacagcaccgggaaccucaucgccccgcggggcuacuucaagauccgcuccgggaaguccuccaucaugcggagcgacgcgcccaucggcaagugcaacuccgccugcaucacccccaacggcagcauccccaacgacaagccguuccagaacgucaaccgcaucacguacggggccugcccccgguacgugaagcagaacacccugaagcuggccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccucgagaaguacguggaggacaccaagaucgaccuguggagcuacaacgcggagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggagcauccgcaacggcaccuacgaccacgacguguaccgggacgaggcccugaacaaccgcuuccagaucaaggggguggagcucaaguccggcuacaaggacuggauccuguggaucagcuucgcgaucuccugcuuccugcucugcgucgcccugcugggcuucaucaugugggccugccagaaggggaacauccggugcaacaucugcaucuga

SEQ ID NO: 71868 - RNA, 1701 nt, Artificial Sequence
  derived and/or modified sequence opt1 from hemagglutinin__InfluenzaA__AHC61643
augaagaccaucaucgcccugagcuacgugcucugccuggucuucgcccagaagcugcccggcaacgacaacuccaccgcgacgcucugccuggggcaccacgccgugccgaacggcaccaucgugaagaccaucaccaacgaccagaucgaggucacgaacgccaccgagcuggugcagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgucccggacuacgcgagccugcggucccucguggccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccgccgggcggaucaccgugagcacgaagcgcucccagcaggccgucaucccgaacaucggcagccggccccgcgugcggaacauccccagccgcguguccaucuacuggaccaucgucaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgcgggguucaucgagaacggcugggagggcaugguggacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgcggagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaagggggucgagcugaaguccggcuacaaggacuggauccuguggaucagcuucgcgaucuccugcuuccuccugugcguggcccugcucggcuucaucaugugggccugccagaaggggaacauccggugcaacaucugcaucuga

SEQ ID NO: 71869 - RNA, 1701 nt, Artificial Sequence
  derived and/or modified sequence opt1 from hemagglutinin__InfluenzaA__AHC61655
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcaacagcccccaccagauccucgacggcgagaacugcacgcugaucgacgcccugcucggggacccccagugcgacggcuuccagaacaacaagugggaccuguucguggagcgcagcaaggcccacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcggccgggcggaucacggugagcaccaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucauccggagcgacgcccccaucggcaagugcaacuccgcgugcaucacgcccaacggcagcauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggcggggccaggcggccgaccucaagagcacccaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 71870 - RNA, 1701 nt, Artificial Sequence
  derived and/or modified sequence opt1 from hemagglutinin__InfluenzaA__AHC61667
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcggaucaccgugagcacgaagcgcagccagcaggccgugaucccgaacaucggcucccggccccgcauccggaacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggccugcccccgguacgugaagcaguccacccugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 71871 - RNA, 1701 nt, Artificial Sequence; identical to SEQ ID NO: 71626
  derived and/or modified sequence opt1 from hemagglutinin__InfluenzaA__AHC61679

SEQ ID NO: 71872 - RNA, 1701 nt, Artificial Sequence; identical to SEQ ID NO: 70082
  derived and/or modified sequence opt1 from hemagglutinin__InfluenzaA__AHC61691

SEQ ID NO: 71873 - RNA, 1701 nt, Artificial Sequence; identical to SEQ ID NO: 67863
  derived and/or modified sequence opt1 from hemagglutinin__InfluenzaA__AHC61703

SEQ ID NO: 71874 - RNA, 1701 nt, Artificial Sequence; identical to SEQ ID NO: 71659
  derived and/or modified sequence opt1 from hemagglutinin__InfluenzaA__AHC61715

SEQ ID NO: 71875 - RNA, 1701 nt, Artificial Sequence; identical to SEQ ID NO: 68790
  derived and/or modified sequence opt1 from hemagglutinin__InfluenzaA__AHC61727

SEQ ID NO: 71876 - RNA, 1701 nt, Artificial Sequence; identical to SEQ ID NO: 67863
  derived and/or modified sequence opt1 from hemagglutinin__InfluenzaA__AHC61739

SEQ ID NO: 71877 - RNA, 1701 nt, Artificial Sequence
  derived and/or modified sequence opt1 from hemagglutinin__InfluenzaA__AHC61751
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacgucggcagccggccccgcgugcggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgucaaccgcaucacguacggggcgugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggcgugccagaaggggaacauccggugcaacaucugcaucuga

SEQ ID NO: 71878 - RNA, 1701 nt, Artificial Sequence
  derived and/or modified sequence opt1 from hemagglutinin__InfluenzaA__AHC61763
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcagaccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgcgugcaucacgcccaacggcagcauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggcggggccaggcggccgaccucaagagcacccaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 71879 - RNA, 1701 nt, Artificial Sequence; identical to SEQ ID NO: 67990
  derived and/or modified sequence opt1 from hemagglutinin__InfluenzaA__AHC61775

SEQ ID NO: 71880 - RNA, 1701 nt, Artificial Sequence; identical to SEQ ID NO: 68790
  derived and/or modified sequence opt1 from hemagglutinin__InfluenzaA__AHC61787

SEQ ID NO: 71881 - RNA, 1701 nt, Artificial Sequence; identical to SEQ ID NO: 71626
  derived and/or modified sequence opt1 from hemagglutinin__InfluenzaA__AHC61799

SEQ ID NO: 71882 - RNA, 1701 nt, Artificial Sequence
  derived and/or modified sequence opt1 from hemagglutinin__InfluenzaA__AHC61823
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugaaguccgacgcccccaucgacaagugcaacagcgagugcaucacccccaacggcuccauccccaacgacaagccguuccagaacgugaaccggaucacguacggcgccugcccccgcuacgugaagcagagcacccugaagcucgcgaccgggaugcggaacguccccgagaagcagacccgcggcaucuucggggccaucgccggcuucaucgagaacgggugggagggcaugguggacggcugguacggguuccggcaccagaacuccgagggccgcgggcaggccgccgaccugaaguccacgcaggcggccaucgaccagaucaacggcaagcugaaccggcucaucgggaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacaugggcaacgggugcuucaagaucuaccacaagugcgacaacgcgugcaucggcagcauccgcaacgggaccuacaaccacgacguguaccgcgacgaggcccucaacaaccgguuccagaucaagggcgucgagcugaaguccggguacaaggacuggauccuguggaucagcuucgccaucagcugcuuccuccugugcguggcccugcucggcuucaucaugugggccugccagaagggcaacauccgcugcaacaucugcaucuga

SEQ ID NO: 71883 - RNA, 1701 nt, Artificial Sequence; identical to SEQ ID NO: 68790
  derived and/or modified sequence opt1 from hemagglutinin__InfluenzaA__AHC61835

SEQ ID NO: 71884 - RNA, 1701 nt, Artificial Sequence; identical to SEQ ID NO: 67990
  derived and/or modified sequence opt1 from hemagglutinin__InfluenzaA__AHC61847

SEQ ID NO: 71885 - RNA, 1701 nt, Artificial Sequence; identical to SEQ ID NO: 67863
  derived and/or modified sequence opt1 from hemagglutinin__InfluenzaA__AHC61859

SEQ ID NO: 71886 - RNA, 1701 nt, Artificial Sequence; identical to SEQ ID NO: 68790
  derived and/or modified sequence opt1 from hemagglutinin__InfluenzaA__AHC61871

SEQ ID NO: 71887 - RNA, 1701 nt, Artificial Sequence
  derived and/or modified sequence opt1 from hemagglutinin__InfluenzaA__AHC61883
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucgccgacuccgagaugaacaagcuguucgagaagacgaagaagcagcugcgcgagaacgcggaggacauggggaacggcugcuucaagaucuaccacaagugcgacaacgccugcaucgggagcauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggcgugccagaaggggaacauccggugcaacaucugcaucuga

SEQ ID NO: 71888 - RNA, 1701 nt, Artificial Sequence; identical to SEQ ID NO: 67990
  derived and/or modified sequence opt1 from hemagglutinin__InfluenzaA__AHC61895

SEQ ID NO: 71889 - RNA, 1701 nt, Artificial Sequence; identical to SEQ ID NO: 67990
  derived and/or modified sequence opt1 from hemagglutinin__InfluenzaA__AHC61907

SEQ ID NO: 71890 - RNA, 1701 nt, Artificial Sequence
  derived and/or modified sequence opt1 from hemagglutinin__InfluenzaA__AHC61931
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaagggcuggauccuguggaucagcuucgcgaucuccugcuuccuccugugcgucgcccugcucggguucaucaugugggccugccagaagggcaacauccggugcaacaucugcaucuga

SEQ ID NO: 71891 - RNA, 1701 nt, Artificial Sequence; identical to SEQ ID NO: 68790
  derived and/or modified sequence opt1 from hemagglutinin__InfluenzaA__AHC61943

SEQ ID NO: 71892 - RNA, 1701 nt, Artificial Sequence; identical to SEQ ID NO: 70082
  derived and/or modified sequence opt1 from hemagglutinin__InfluenzaA__AHC61955

SEQ ID NO: 71893 - RNA, 1701 nt, Artificial Sequence; identical to SEQ ID NO: 68790
  derived and/or modified sequence opt1 from hemagglutinin__InfluenzaA__AHC61967

SEQ ID NO: 71894 - RNA, 1701 nt, Artificial Sequence; identical to SEQ ID NO: 67863
  derived and/or modified sequence opt1 from hemagglutinin__InfluenzaA__AHC61979

SEQ ID NO: 71895 - RNA, 1701 nt, Artificial Sequence; identical to SEQ ID NO: 67990
  derived and/or modified sequence opt1 from hemagglutinin__InfluenzaA__AHC61991

SEQ ID NO: 71896 - RNA, 1701 nt, Artificial Sequence; identical to SEQ ID NO: 71701
  derived and/or modified sequence opt1 from hemagglutinin__InfluenzaA__AHC62003

SEQ ID NO: 71897 - RNA, 1701 nt, Artificial Sequence; identical to SEQ ID NO: 68790
  derived and/or modified sequence opt1 from hemagglutinin__InfluenzaA__AHC62015

SEQ ID NO: 71898 - RNA, 1701 nt, Artificial Sequence; identical to SEQ ID NO: 70082
  derived and/or modified sequence opt1 from hemagglutinin__InfluenzaA__AHC62027

SEQ ID NO: 71899 - RNA, 1701 nt, Artificial Sequence
  derived and/or modified sequence opt1 from hemagglutinin__InfluenzaA__AHC62039
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcggguccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgugaucccgaacaucggcagccgcccccggguccgcaacauccccucccgggugagcaucuacuggaccaucgugaagcccggggacauccugcucaucaacuccaccggcaaccugaucgccccgcgcggguacuucaagauccggagcggcaaguccagcaucaugaaguccgacgcccccaucggcaagugcaacagcgcgugcaucacccccaacggguccauccccaacgacaagccguuccagaacgucaaccgcaucacguacggcgccugcccccgguacgugaagcagaacacccugaagcucgccaccgggaugcgcaacgugcccgagaagcagacccggggcaucuucggggccaucgccggcuucaucgagaacggcugggaggggaugauggacggcugguacggguuccgccaccagaacagcgagggccgggggcaggcggccgaccugaaguccacgcaggccgccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgcuuccagaucaagggcguggagcugaaguccggcuacaaggacuggauccuguggaucuccuucgccaucagcugcuuccuccugugcguggcgcugcucggguucaucaugugggccugccagaagggcaacauccggugcaacaucugcaucuga

SEQ ID NO: 71900 - RNA, 1701 nt, Artificial Sequence
  derived and/or modified sequence opt1 from hemagglutinin__InfluenzaA__AHC62050
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacgugcccucccgcgugagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 71901 - RNA, 1701 nt, Artificial Sequence; identical to SEQ ID NO: 70082
  derived and/or modified sequence opt1 from hemagglutinin__InfluenzaA__AHC62062

SEQ ID NO: 71902 - RNA, 1701 nt, Artificial Sequence
  derived and/or modified sequence opt1 from hemagglutinin__InfluenzaA__AHC62074
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcaaccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacaaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 71903 - RNA, 1701 nt, Artificial Sequence; identical to SEQ ID NO: 67863
  derived and/or modified sequence opt1 from hemagglutinin__InfluenzaA__AHC62086

SEQ ID NO: 71904 - RNA, 1701 nt, Artificial Sequence; identical to SEQ ID NO: 68790
  derived and/or modified sequence opt1 from hemagglutinin__InfluenzaA__AHC62098

SEQ ID NO: 71905 - RNA, 1701 nt, Artificial Sequence; identical to SEQ ID NO: 67863
  derived and/or modified sequence opt1 from hemagglutinin__InfluenzaA__AHC62110

SEQ ID NO: 71906 - RNA, 1701 nt, Artificial Sequence
  derived and/or modified sequence opt1 from hemagglutinin__InfluenzaA__AHC62122
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagaugguccagagcuccagcaccggggagaucugcaacagcccccaccagauccuggacggcgagaacugcacccucaucgacgcccugcugggggacccccagugcgacggcuuccagaacaagaagugggaccucuucguggagcgcagcaaggcccacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgcggguccaacaacagcuucuucucccggcugaacuggcugacgcacagcaacuucaaguaccccgcccucaacgugaccaugcccaacaacgagcaguucgacaagcuguacaucuggggcguccaccaccccgggaccgacaaggaccagaucuuccuguacgcgcaggccuccggccgcaucaccgugagcacgaagcggagccagcaggccgugaucccgaacaucggcucccgcccccggguccgcaacauccccagccggguguccaucuacuggaccaucgugaagcccggggacauccuccugaucaacagcaccggcaaccugaucgccccgcgcggguacuucaagauccgguccggcaagagcuccaucaugcgcagcgacgcccccaucggcaagugcaacuccgcgugcaucacccccaacgggagcauccccaacgacaagccguuccagaacgucaaccggaucacguacggcgccugcccccgcuacgugaagcagaacacccucaagcuggccaccgggaugcggaacgugcccgagaagcagacccgcggcaucuucggggccaucgccggcuucaucgagaacggcugggaggggauggucgacggcugguacggguuccggcaccagaacuccgagggccgcgggcaggcggccgaccugaaguccacgcaggccgccaucgaccagaucaacggcaagcucaaccggcugaucggcaagaccaacgagaaguuccaccagaucgagaaggaguucuccgagguggaggggcgcauccaggaccuggagaaguacguggaggacaccaagaucgaccucuggagcuacaacgccgagcugcuggucgcgcucgagaaccagcacaccaucgaccugacggacuccgagaugaacaagcuguucgagaagaccaagaagcagcuccgggagaacgccgaggacaugggcaacgggugcuucaagaucuaccacaagugcgacaacgccugcaucggcagcauccgcaacgggaccuacgaccacgacguguaccgcgacgaggcccugaacaaccgguuccgcaucaagggcguggagcugaaguccggcuacaaggacuggauccucuggaucagcuucgccaucuccugcuuccugcugugcgucgcgcuccugggguucaucaugugggccugccagaagggcaacauccggugcaacaucugcaucuga

SEQ ID NO: 71907 - RNA, 1701 nt, Artificial Sequence; identical to SEQ ID NO: 67863
  derived and/or modified sequence opt1 from hemagglutinin__InfluenzaA__AHC62134

SEQ ID NO: 71908 - RNA, 1701 nt, Artificial Sequence
  derived and/or modified sequence opt1 from hemagglutinin__InfluenzaA__AHC62146
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuacgaggggcggggccaggccgccgaccugaaguccacgcaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 71909 - RNA, 1701 nt, Artificial Sequence; identical to SEQ ID NO: 67990
  derived and/or modified sequence opt1 from hemagglutinin__InfluenzaA__AHC62158

SEQ ID NO: 71910 - RNA, 1701 nt, Artificial Sequence
  derived and/or modified sequence opt1 from hemagglutinin__InfluenzaA__AHC62170
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcggguccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgugaucccgaacaucggcagccgcccccggguccgcaacauccccucccgggugagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggaugauggacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacaacgucuaccgcgacgaggcccucaacaaccgguuccagaucaagggcguggagcugaaguccggcuacaaggacuggauccuguggaucuccuucgccaucagcugcuuccuccugugcguggcgcugcucggguucaucaugugggccugccagaagggcaacauccgcugcaacaucugcaucuga

SEQ ID NO: 71911 - RNA, 1701 nt, Artificial Sequence; identical to SEQ ID NO: 67863
  derived and/or modified sequence opt1 from hemagglutinin__InfluenzaA__AHC62182

SEQ ID NO: 71912 - RNA, 1701 nt, Artificial Sequence; identical to SEQ ID NO: 70082
  derived and/or modified sequence opt1 from hemagglutinin__InfluenzaA__AHC62194

SEQ ID NO: 71913 - RNA, 1701 nt, Artificial Sequence
  derived and/or modified sequence opt1 from hemagglutinin__InfluenzaA__AHC62206
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaucuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 71914 - RNA, 1701 nt, Artificial Sequence; identical to SEQ ID NO: 67990
  derived and/or modified sequence opt1 from hemagglutinin__InfluenzaA__AHC62218

SEQ ID NO: 71915 - RNA, 1701 nt, Artificial Sequence
  derived and/or modified sequence opt1 from hemagglutinin__InfluenzaA__AHC62242
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagaacagcuccaccggggagaucugcgacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaacaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucaucgcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacguguaccgggacgaggcccugaacaaccgcuuccagaucaagggggucgagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 71916 - RNA, 1701 nt, Artificial Sequence; identical to SEQ ID NO: 71625
  derived and/or modified sequence opt1 from hemagglutinin__InfluenzaA__AHC62254

SEQ ID NO: 71917 - RNA, 1701 nt, Artificial Sequence; identical to SEQ ID NO: 67990
  derived and/or modified sequence opt1 from hemagglutinin__InfluenzaA__AHC62266

SEQ ID NO: 71918 - RNA, 1701 nt, Artificial Sequence; identical to SEQ ID NO: 71789
  derived and/or modified sequence opt1 from hemagglutinin__InfluenzaA__AHC62278

SEQ ID NO: 71919 - RNA, 1701 nt, Artificial Sequence
  derived and/or modified sequence opt1 from hemagglutinin__InfluenzaA__AHC62290
augaagaccaucaucgcccugagcuacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagagcuccagcaccggggagaucugcaacagcccccaccagauccucgacggcgagaacugcacccugaucgacgcccugcucggggacccccagugcgacggcuuccagaacaagaagugggaccuguucgucgagcgcagcaaggcccacuccaacugcuaccccuacgacgugccggacuacgcgagccugcggucccucguggccagcuccggcacgcuggaguucaacaacgagagcuucaacuggaccggggucacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccagcgggcggaucaccgucuccacgaagcgcagccagcaggccgugaucccgaacaucggcagccggccccgcgugcggaacauccccucccgcgucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 71920 - RNA, 1701 nt, Artificial Sequence
  derived and/or modified sequence opt1 from hemagglutinin__InfluenzaA__AHC62302
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcaacgggaaguccagcaucaugcgguccgacgcgcccaucggcaagugcaacagcgccugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacagcgaggggcggggccaggccgccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgcggagcuccuggucgcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgcgaucagcugcuuccuccugugcgucgcccugcucggcuucaucaugugggccugccagaaggggaacauccggugcaacaucugcaucuga

SEQ ID NO: 71921 - RNA, 1701 nt, Artificial Sequence
  derived and/or modified sequence opt1 from hemagglutinin__InfluenzaA__AHC62314
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagauccgcgggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 71922 - RNA, 1701 nt, Artificial Sequence; identical to SEQ ID NO: 71786
  derived and/or modified sequence opt1 from hemagglutinin__InfluenzaA__AHC62326

SEQ ID NO: 71923 - RNA, 1701 nt, Artificial Sequence; identical to SEQ ID NO: 68790
  derived and/or modified sequence opt1 from hemagglutinin__InfluenzaA__AHC62338

SEQ ID NO: 71924 - RNA, 1701 nt, Artificial Sequence; identical to SEQ ID NO: 67863
  derived and/or modified sequence opt1 from hemagglutinin__InfluenzaA__AHC62350

SEQ ID NO: 71925 - RNA, 1701 nt, Artificial Sequence; identical to SEQ ID NO: 68790
  derived and/or modified sequence opt1 from hemagglutinin__InfluenzaA__AHC62362

SEQ ID NO: 71926 - RNA, 1701 nt, Artificial Sequence; identical to SEQ ID NO: 68790
  derived and/or modified sequence opt1 from hemagglutinin__InfluenzaA__AHC62374

SEQ ID NO: 71927 - RNA, 1701 nt, Artificial Sequence; identical to SEQ ID NO: 71789
  derived and/or modified sequence opt1 from hemagglutinin__InfluenzaA__AHC62386

SEQ ID NO: 71928 - RNA, 1701 nt, Artificial Sequence; identical to SEQ ID NO: 67863
  derived and/or modified sequence opt1 from hemagglutinin__InfluenzaA__AHC62398

SEQ ID NO: 71929 - RNA, 1701 nt, Artificial Sequence
  derived and/or modified sequence opt1 from hemagglutinin__InfluenzaA__AHC62410
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucauccgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 71930 - RNA, 1701 nt, Artificial Sequence; identical to SEQ ID NO: 71732
  derived and/or modified sequence opt1 from hemagglutinin__InfluenzaA__AHC62422

SEQ ID NO: 71931 - RNA, 1701 nt, Artificial Sequence
  derived and/or modified sequence opt1 from hemagglutinin__InfluenzaA__AHC62434
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccaguccgggaaguccuccaucaugcgcagcgacgcgcccaucggcaagugcaacuccgccugcaucacccccaacggcagcauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgcgggguucaucgagaacggcugggagggcauggucgacgggugguacggcuuccggcaccagaacuccgaggggcgcggccaggccgccgaccucaagagcacgcaggccgccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgccugcaucgggagcauccgcaacggcaccuacgaccacgacguguaccgcgacgaggcccucaacaaccgguuccagaucaaggggguggagcugaaguccggcuacaaggacuggauccuguggaucagcuucgcgaucuccugcuuccuccugugcgucgcccugcucggcuucaucaugugggccugccagaaggggaacauccgcugcaacaucugcaucuga

SEQ ID NO: 71932 - RNA, 1701 nt, Artificial Sequence; identical to SEQ ID NO: 67863
  derived and/or modified sequence opt1 from hemagglutinin__InfluenzaA__AHC62446

SEQ ID NO: 71933 - RNA, 1701 nt, Artificial Sequence; identical to SEQ ID NO: 67990
  derived and/or modified sequence opt1 from hemagglutinin__InfluenzaA__AHC62458

SEQ ID NO: 71934 - RNA, 1701 nt, Artificial Sequence
  derived and/or modified sequence opt1 from hemagglutinin__InfluenzaA__AHC62470
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgggaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacuccgagggccgggggcaggccgcggaccucaagagcacgcaggccgccaucgaccagaucaacggcaagcugaaccgccugaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacaugggcaacgggugcuucaagaucuaccacaagugcgacaacgccugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 71935 - RNA, 1701 nt, Artificial Sequence; identical to SEQ ID NO: 71687
  derived and/or modified sequence opt1 from hemagglutinin__InfluenzaA__AHC62482

SEQ ID NO: 71936 - RNA, 1701 nt, Artificial Sequence; identical to SEQ ID NO: 67863
  derived and/or modified sequence opt1 from hemagglutinin__InfluenzaA__AHC62506

SEQ ID NO: 71937 - RNA, 1701 nt, Artificial Sequence; identical to SEQ ID NO: 67990
  derived and/or modified sequence opt1 from hemagglutinin__InfluenzaA__AHC62518

SEQ ID NO: 71938 - RNA, 1701 nt, Artificial Sequence
  derived and/or modified sequence opt1 from hemagglutinin__InfluenzaA__AHC62530
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcaacagcccccaccagauccuggacggcgagaacugcacccucaucgacgcccugcugggggacccccagugcgacggcuuccagaacaagaagugggaccucuucguggagcgcuccaaggcccacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcugaucaacuccaccgggaaccucaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcuggccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccucaaguccacgcaggccgccaucgaccagaucaacgggaagcugaaccgccugaucggcaagaccaacgagaaguuccaccagaucgagaaggaguucagcgagguggagggccggauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagagcggcuacaaggacuggauccuguggaucuccuucgccaucagcugcuuccugcucugcgucgcgcugcugggcuucaucaugugggccugccagaaggggaacauccggugcaacaucugcaucuga

SEQ ID NO: 71939 - RNA, 1701 nt, Artificial Sequence; identical to SEQ ID NO: 71659
  derived and/or modified sequence opt1 from hemagglutinin__InfluenzaA__AHC62542

SEQ ID NO: 71940 - RNA, 1701 nt, Artificial Sequence; identical to SEQ ID NO: 67863
  derived and/or modified sequence opt1 from hemagglutinin__InfluenzaA__AHC62554

SEQ ID NO: 71941 - RNA, 1701 nt, Artificial Sequence
  derived and/or modified sequence opt1 from hemagglutinin__InfluenzaA__AHC62566
augaagaccaucaucgcccugagcuacauccucugccugguguucgcccagaagcugcccggcaacgacaacuccaccgcgacgcucugccuggggcaccacgccgucccgaacggcaccauggugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 71942 - RNA, 1701 nt, Artificial Sequence; identical to SEQ ID NO: 67863
  derived and/or modified sequence opt1 from hemagglutinin__InfluenzaA__AHC62578

SEQ ID NO: 71943 - RNA, 1701 nt, Artificial Sequence; identical to SEQ ID NO: 67863
  derived and/or modified sequence opt1 from hemagglutinin__InfluenzaA__AHC62590

SEQ ID NO: 71944 - RNA, 1701 nt, Artificial Sequence; identical to SEQ ID NO: 67990
  derived and/or modified sequence opt1 from hemagglutinin__InfluenzaA__AHC62602

SEQ ID NO: 71945 - RNA, 1701 nt, Artificial Sequence
  derived and/or modified sequence opt1 from hemagglutinin__InfluenzaA__AHC62614
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagaucaucgacggcgagaacugcacccucaucgacgcccugcugggggacccccagugcgacggcuuccagaacaagaagugggaccucuucguggagcgcuccaaggcccacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgcggguccaacaacagcuucuucucccggcugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcggccgcaucaccguguccacgaagcggagccagcaggccgugaucccgaacaucggcagccgcccccggguccgcaacauccccucccgggugagcaucuacuggaccaucgugaagcccggggacauccugcugaucaacuccaccggcaaccucaucgccccgcgcggguacuucaagauccggagcggcaaguccagcaucaugcgcuccgacgcccccaucggcaagugcaacagcgcgugcaucacccccaacggguccauccccaacgacaagccguuccagaacgucaaccggaucacguacggcgccugcccccgcuacgugaagcagaacacccugaagcuggccaccgggaugcggaacgugcccgagaagcagacccgcggcaucuucggggccaucgccggcuucaucgagaacggcugggaggggauggucgacggcugguacggguuccggcaccagaacagcgagggccgcgggcaggcggccgaccucaaguccacgcaggccgccaucgaccagaucaacggcaagcugaaccggcugaucggcaagaccaacgagaaguuccaccagaucgagaaggaguucagcgagguggaggggcgcauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgggagaacgccgaggacaugggcaacgggugcuucaagaucuaccacaagugcgacaacgccugcaucggcuccauccgcaacgggaccuacgaccacgacguguaccgcgacgaggcccugaacaaccgguuccagaucaagggcguggagcucaagagcggcuacaaggacuggauccuguggaucuccuucgccaucagcugcuuccugcucugcgucgcgcugcugggguucaucaugugggccugccagaagggcaacauccgcugcaacaucugcaucuga

SEQ ID NO: 71946 - RNA, 1701 nt, Artificial Sequence; identical to SEQ ID NO: 71626
  derived and/or modified sequence opt1 from hemagglutinin__InfluenzaA__AHC62626

SEQ ID NO: 71947 - RNA, 1701 nt, Artificial Sequence; identical to SEQ ID NO: 67990
  derived and/or modified sequence opt1 from hemagglutinin__InfluenzaA__AHC62638

SEQ ID NO: 71948 - RNA, 1701 nt, Artificial Sequence; identical to SEQ ID NO: 71790
  derived and/or modified sequence opt1 from hemagglutinin__InfluenzaA__AHC62650

SEQ ID NO: 71949 - RNA, 1701 nt, Artificial Sequence
  derived and/or modified sequence opt1 from hemagglutinin__InfluenzaA__AHC62662
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccagcugcuaccccuacgacgugccggacuacgcgucccugcggagccucgucgccuccagcggcacgcuggaguucaacaacgaguccuucaacuggaccggggugacccagaacggcaccagcuccgccugcauccgcgggagcaacaacuccuucuucagccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccgcaucaccgugagcacgaagcggagccagcaggccgugaucccgaacaucggcucccgcccccggguccgcaacauccccagccggguguccaucuacuggaccaucgugaagcccggggacauccugcucaucaacagcaccggcaaccugaucgccccgcgcggguacuucaagauccgguccggcaagagcuccaucaugcgcagcgacgcccccaucggcaagugcaacuccgcgugcaucacccccaacgggagcauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacuccgagggccgcgggcaggcggccgaccugaaguccacgcaggccgccaucgaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgggagaacgccgaggacaugggcaacgggugcuucaagaucuaccacaagugcgacaacgccugcaucggcagcauccgcaacgggaccuacgaccacgacguguaccgcgacgaggcccucaacaaccgguuccagaucaagggcguggagcugaaguccggcuacaaggacuggauccuguggaucagcuucgccaucuccugcuuccuccugugcgucgcgcugcucggguucaucaugugggccugccagaagggcaacauccgcugcaacaucugcaucuga

SEQ ID NO: 71950 - RNA, 1701 nt, Artificial Sequence
  derived and/or modified sequence opt1 from hemagglutinin__InfluenzaA__AHC62674
augaagaccaucaucgcccugagcuacauccucugccugguguucgcccagaagcugcccggcaacgacaacuccaccgcgacccucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucaucgccagcuccggcacgcuggaguucaacaacgagagcuucaacuggaccggggucacccagaacggcaccuccagcgccugcauccgcggguccaacaacagcuucuucucccggcugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccagcggccgcaucaccgucuccacgaagcggagccagcaggccgugaucccgaacaucggcagccgcccccgggugcgcaacauccccucccgggucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgcgugcaucacccccaacggguccauccccaacgacaagccguuccagaacgugaaccggaucacguacggcgccugcccccgcuacgucaagcagaacacccugaagcucgccaccgggaugcggaacgugcccgagaagcagacccgcggcaucuucggggccaucgccggcuucaucgagaacggcugggaggggaugguggacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgggagaacgccgaggacaugggcaacgggugcuucaagaucuaccacaagugcgacaacacgugcaucgaguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggcgugccagaaggggaacauccgcugcaacaucugcaucuga

SEQ ID NO: 71951 - RNA, 1701 nt, Artificial Sequence; identical to SEQ ID NO: 71068
  derived and/or modified sequence opt1 from hemagglutinin__InfluenzaA__AHE37972

SEQ ID NO: 71952 - RNA, 1701 nt, Artificial Sequence
  derived and/or modified sequence opt1 from hemagglutinin__InfluenzaA__AHE37973
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcaccaaguccuucuacaagaaccugaucuggcucgugaagaaggggaacagcuaccccaagcuguccaagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaucaacuacuacuggacccugaucgagcccggggacaagaucacguucgaggccaccggcaaccucguggugccccgguacgcguucgccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 71953 - RNA, 1701 nt, Artificial Sequence
  derived and/or modified sequence opt1 from hemagglutinin__InfluenzaA__AHE37974
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagcaaguacuccaagaaguucaagcccgagaucgccauccggccgaagguccgcgaccaggagggccggaugaacuacuacuggacccugaucgagcccggggacaagaucaccuucgaggcgacgggcaaccucguggugccccgcuacgccuucgccauggagcggaacgccgggagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcgccucgcgacgggccugcggaacgugccgagcauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgagaagaucgacggcgugaagcucgagagcacccggaucuaccagauccuggcgaucuacuccaccguggccagcucccugguccucguggugagccugggggccaucagcuucuggaugugcuccaacggcagccugcagugccgcaucugcaucuga

SEQ ID NO: 71954 - RNA, 1701 nt, Artificial Sequence; identical to SEQ ID NO: 71048
  derived and/or modified sequence opt1 from hemagglutinin__InfluenzaA__AHE37975

SEQ ID NO: 71955 - RNA, 1701 nt, Artificial Sequence
  derived and/or modified sequence opt1 from hemagglutinin__InfluenzaA__AHE37976
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccgccgccagcuccuggagcuacaucguggagaccuccagcuccaacaacgggaccugcuaccccggcgacuucaucaacuacgaggagcuccgggagcagcugagcuccgugagcuccuucgagcgcuucgagaucuuccccaagacgagcuccuggcccaaccacgacagcaacaagggcgucaccgccgccugcccgcacgcgggcgccaaguccuucuacaagaaccugaucuggcucgugaagaaggggaacagcuaccccaagcuguccaagagcuacaucaacgacaagggcaaggagauccuggugcucugggggauccaccaccccagcaccaccacggaccagcagucccuguaccagaacgccgacgccuacgucuucgugggcaccagccgguacuccaagaaguucaagcccgagaucgccauccgcccgaaggugcgggaccaggagggccgcaugaacuacuacuggacccugaucgagcccggggacaagaucaccuucgaggcgacgggcaaccucgucgugccccgguacgccuucgccauggagcgcaacgccgggagcggcaucaucaucuccgacacccccgugcacgacugcaacacgaccugccagaccccggagggcgccaucaacaccagccugcccuuccagaacauccaccccaucaccaucgggaagugccccaaguacgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccggggcaagaucgacggggucaagcucgagagcacccgcaucuaccagauccuggcgaucuacuccaccguggccagcucccuggugcucgucgugagccugggcgccaucagcuucuggaugugcuccaacggcagccugcagugccggaucugcaucuga

SEQ ID NO: 71956 - RNA, 1701 nt, Artificial Sequence; identical to SEQ ID NO: 71048
  derived and/or modified sequence opt1 from hemagglutinin__InfluenzaA__AHE37977

SEQ ID NO: 71957 - RNA, 1701 nt, Artificial Sequence; identical to SEQ ID NO: 71068
  derived and/or modified sequence opt1 from hemagglutinin__InfluenzaA__AHE37978

SEQ ID NO: 71958 - RNA, 1701 nt, Artificial Sequence; identical to SEQ ID NO: 71048
  derived and/or modified sequence opt1 from hemagglutinin__InfluenzaA__AHE37979

SEQ ID NO: 71959 - RNA, 1701 nt, Artificial Sequence
  derived and/or modified sequence opt1 from hemagglutinin__InfluenzaA__AHE37980
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgcggccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucacguucgaggccaccggcaaccucguggugccccgguacgcguucgccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 71960 - RNA, 1701 nt, Artificial Sequence
  derived and/or modified sequence opt1 from hemagglutinin__InfluenzaA__AHE37981
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagcaaguacuccaagaaguucaagcccgagaucgccauccggccgaagguccgcgaccaggagggccggaugaacuacuacuggacccugaucgagcccggggacaagaucaccuucgaggcgacgggcaaccucguggugccccgcuacgccuucgccauggagcggaacgccgggagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcgccucgcgacgggccugcggaacgugccgagcauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacauccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgagaagaucgacggcgugaagcucgagagcacccggaucuaccagauccuggcgaucuacuccaccguggccagcucccugguccucguggugagccugggggccaucagcuucuggaugugcuccaacggcagccugcagugccgcaucugcaucuga

SEQ ID NO: 71961 - RNA, 1701 nt, Artificial Sequence; identical to SEQ ID NO: 71048
  derived and/or modified sequence opt1 from hemagglutinin__InfluenzaA__AHE37982

SEQ ID NO: 71962 - RNA, 1701 nt, Artificial Sequence
  derived and/or modified sequence opt1 from hemagglutinin__InfluenzaA__AHE37983
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccgagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 71963 - RNA, 1701 nt, Artificial Sequence
  derived and/or modified sequence opt1 from hemagglutinin__InfluenzaA__AHE37984
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 71964 - RNA, 1701 nt, Artificial Sequence
  derived and/or modified sequence opt1 from hemagglutinin__InfluenzaA__AHE37985
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugaaguccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 71965 - RNA, 1701 nt, Artificial Sequence; identical to SEQ ID NO: 70930
  derived and/or modified sequence opt1 from hemagglutinin__InfluenzaA__AHE37986

SEQ ID NO: 71966 - RNA, 1701 nt, Artificial Sequence; identical to SEQ ID NO: 70866
  derived and/or modified sequence opt1 from hemagglutinin__InfluenzaA__AHE37987

SEQ ID NO: 71967 - RNA, 1701 nt, Artificial Sequence
  derived and/or modified sequence opt1 from hemagglutinin__InfluenzaA__AHE37988
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugauggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccagaaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 71968 - RNA, 1701 nt, Artificial Sequence; identical to SEQ ID NO: 71002
  derived and/or modified sequence opt1 from hemagglutinin__InfluenzaA__AHE37989

SEQ ID NO: 71969 - RNA, 1701 nt, Artificial Sequence; identical to SEQ ID NO: 70866
  derived and/or modified sequence opt1 from hemagglutinin__InfluenzaA__AHE37990

SEQ ID NO: 71970 - RNA, 1701 nt, Artificial Sequence; identical to SEQ ID NO: 70866
  derived and/or modified sequence opt1 from hemagglutinin__InfluenzaA__AHE37991

SEQ ID NO: 71971 - RNA, 1701 nt, Artificial Sequence
  derived and/or modified sequence opt1 from hemagglutinin__InfluenzaA__AHE37992
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucgacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 71972 - RNA, 1701 nt, Artificial Sequence; identical to SEQ ID NO: 71048
  derived and/or modified sequence opt1 from hemagglutinin__InfluenzaA__AHE38023

SEQ ID NO: 71973 - RNA, 1701 nt, Artificial Sequence
  derived and/or modified sequence opt1 from hemagglutinin__InfluenzaA__AHE38024
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccacccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 71974 - RNA, 1701 nt, Artificial Sequence
  derived and/or modified sequence opt1 from hemagglutinin__InfluenzaA__AHE38026
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgagaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 71975 - RNA, 1701 nt, Artificial Sequence; identical to SEQ ID NO: 70891
  derived and/or modified sequence opt1 from hemagglutinin__InfluenzaA__AHE38027

SEQ ID NO: 71976 - RNA, 1683 nt, Artificial Sequence
  derived and/or modified sequence opt1 from hemagglutinin__InfluenzaA__AHF20558
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucaccuucagcuucaacggcgcguucaucgcccccgaccgcgccuccuuccuccggggcaagagcauggggauccaguccggcguccagguggacgccaacugcgagggggacugcuaccacagcggcgggacgaucaucuccaaccugcccuuccagaacaucgacagccgcgccgugggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgcgaucgugauggggcuggucuucaucugcgugcagaacggcaacaugcgcugcaccaucgggaucuga

SEQ ID NO: 71977 - RNA, 1683 nt, Artificial Sequence
  derived and/or modified sequence opt1 from hemagglutinin__InfluenzaA__AHF20568
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucaccuucagcuucaacggcgcguucaucgcccccgaccgcgccuccuuccuccggggcaagagcauggggauccaguccggcguccagguggacgccaacugcgagggggacugcuaccacagcggcgggacgaucauguccaaccugcccuuccagaacaucgacagccgcgccgugggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgcgaucgugauggggcuggucuucaucugcgugaagaacggcaacaugcgcugcaccaucugcaucuga

SEQ ID NO: 71978 - RNA, 1698 nt, Artificial Sequence; identical to SEQ ID NO: 68801
  derived and/or modified sequence opt1 from hemagglutinin__InfluenzaA__AHG96108

SEQ ID NO: 71979 - RNA, 1698 nt, Artificial Sequence; identical to SEQ ID NO: 68801
  derived and/or modified sequence opt1 from hemagglutinin__InfluenzaA__AHG96120

SEQ ID NO: 71980 - RNA, 1698 nt, Artificial Sequence; identical to SEQ ID NO: 68801
  derived and/or modified sequence opt1 from hemagglutinin__InfluenzaA__AHG96132

SEQ ID NO: 71981 - RNA, 1698 nt, Artificial Sequence
  derived and/or modified sequence opt1 from hemagglutinin__InfluenzaA__AHG96144
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaaggcccuguaccacaccgagaacgccuacgucagcguggugagcucccacuacagccggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 71982 - RNA, 1698 nt, Artificial Sequence; identical to SEQ ID NO: 68801
  derived and/or modified sequence opt1 from hemagglutinin__InfluenzaA__AHG96156

SEQ ID NO: 71983 - RNA, 1698 nt, Artificial Sequence; identical to SEQ ID NO: 68801
  derived and/or modified sequence opt1 from hemagglutinin__InfluenzaA__AHG96168

SEQ ID NO: 71984 - RNA, 1698 nt, Artificial Sequence; identical to SEQ ID NO: 68801
  derived and/or modified sequence opt1 from hemagglutinin__InfluenzaA__AHG96180

SEQ ID NO: 71985 - RNA, 1698 nt, Artificial Sequence; identical to SEQ ID NO: 68801
  derived and/or modified sequence opt1 from hemagglutinin__InfluenzaA__AHG96192

SEQ ID NO: 71986 - RNA, 1698 nt, Artificial Sequence; identical to SEQ ID NO: 68801
  derived and/or modified sequence opt1 from hemagglutinin__InfluenzaA__AHG96204

SEQ ID NO: 71987 - RNA, 1698 nt, Artificial Sequence; identical to SEQ ID NO: 68801
  derived and/or modified sequence opt1 from hemagglutinin__InfluenzaA__AHG96216

SEQ ID NO: 71988 - RNA, 1698 nt, Artificial Sequence; identical to SEQ ID NO: 68801
  derived and/or modified sequence opt1 from hemagglutinin__InfluenzaA__AHG96228

SEQ ID NO: 71989 - RNA, 1698 nt, Artificial Sequence; identical to SEQ ID NO: 71981
  derived and/or modified sequence opt1 from hemagglutinin__InfluenzaA__AHG96240

SEQ ID NO: 71990 - RNA, 1698 nt, Artificial Sequence; identical to SEQ ID NO: 68801
  derived and/or modified sequence opt1 from hemagglutinin__InfluenzaA__AHG96252

SEQ ID NO: 71991 - RNA, 1698 nt, Artificial Sequence; identical to SEQ ID NO: 68801
  derived and/or modified sequence opt1 from hemagglutinin__InfluenzaA__AHG96264

SEQ ID NO: 71992 - RNA, 1698 nt, Artificial Sequence; identical to SEQ ID NO: 68801
  derived and/or modified sequence opt1 from hemagglutinin__InfluenzaA__AHG96276

SEQ ID NO: 71993 - RNA, 1698 nt, Artificial Sequence; identical to SEQ ID NO: 68801
  derived and/or modified sequence opt1 from hemagglutinin__InfluenzaA__AHG96288

SEQ ID NO: 71994 - RNA, 1698 nt, Artificial Sequence; identical to SEQ ID NO: 68801
  derived and/or modified sequence opt1 from hemagglutinin__InfluenzaA__AHG96300

SEQ ID NO: 71995 - RNA, 1701 nt, Artificial Sequence
  derived and/or modified sequence opt1 from hemagglutinin__InfluenzaA__AHG96312
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgugccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgucagcuccuucgagcgcuucgagaucuuccccaagaccagcuccuggcccaaccacgacagcaacaagggggugaccgcggccugcccgcacgccggcgccaaguccuucuacaagaaccugaucuggcucgugaagaaggggaacagcuaccccaagcugucccagagcuacaucaacgacaagggcaaggagguccuggugcucugggggauccaccaccccagcaccacggcggaccagcagucccuguaccagaacgccgacgccuacguguucgucggcaccagccgguacuccaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgucaaguccacgaagcugcggcucgccaccggccugcgcaacgugccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgucaagcucgagagcacccgcaucuaccagauccuggccaucuacuccaccguggccagcucccuggugcucgucgugagccugggggcgaucagcuucuggaugugcuccaacggcagccugcagugccggaucugcaucuga

SEQ ID NO: 71996 - RNA, 1701 nt, Artificial Sequence; identical to SEQ ID NO: 71048
  derived and/or modified sequence opt1 from hemagglutinin__InfluenzaA__AHG96313

SEQ ID NO: 71997 - RNA, 1701 nt, Artificial Sequence
  derived and/or modified sequence opt1 from hemagglutinin__InfluenzaA__AHG96314
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguacaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 71998 - RNA, 1701 nt, Artificial Sequence; identical to SEQ ID NO: 71048
  derived and/or modified sequence opt1 from hemagglutinin__InfluenzaA__AHG96315

SEQ ID NO: 71999 - RNA, 1701 nt, Artificial Sequence; identical to SEQ ID NO: 71048
  derived and/or modified sequence opt1 from hemagglutinin__InfluenzaA__AHG96316

SEQ ID NO: 72000 - RNA, 1701 nt, Artificial Sequence; identical to SEQ ID NO: 71048
  derived and/or modified sequence opt1 from hemagglutinin__InfluenzaA__AHG96317

SEQ ID NO: 72001 - RNA, 1701 nt, Artificial Sequence; identical to SEQ ID NO: 71048
  derived and/or modified sequence opt1 from hemagglutinin__InfluenzaA__AHG96320

SEQ ID NO: 72002 - RNA, 1701 nt, Artificial Sequence; identical to SEQ ID NO: 71048
  derived and/or modified sequence opt1 from hemagglutinin__InfluenzaA__AHG96321

SEQ ID NO: 72003 - RNA, 1701 nt, Artificial Sequence; identical to SEQ ID NO: 71048
  derived and/or modified sequence opt1 from hemagglutinin__InfluenzaA__AHG96322

SEQ ID NO: 72004 - RNA, 1701 nt, Artificial Sequence; identical to SEQ ID NO: 71048
  derived and/or modified sequence opt1 from hemagglutinin__InfluenzaA__AHG96324

SEQ ID NO: 72005 - RNA, 1701 nt, Artificial Sequence; identical to SEQ ID NO: 71048
  derived and/or modified sequence opt1 from hemagglutinin__InfluenzaA__AHG96325

SEQ ID NO: 72006 - RNA, 1701 nt, Artificial Sequence
  derived and/or modified sequence opt1 from hemagglutinin__InfluenzaA__AHG96326
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucaacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagccaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucagcgacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 72007 - RNA, 1701 nt, Artificial Sequence; identical to SEQ ID NO: 71048
  derived and/or modified sequence opt1 from hemagglutinin__InfluenzaA__AHG96327

SEQ ID NO: 72008 - RNA, 1701 nt, Artificial Sequence
  derived and/or modified sequence opt1 from hemagglutinin__InfluenzaA__AHG96329
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagauccgcaaccagcugaagaacaacgccaaggagaucgggaacggcugcuucgaguucuaccacaagugcgacaacacgugcauggagagcgucaagaacgggaccuacgaguaccccaaguacuccgaggaggccaagcugaaccgggagaagaucgacggcgugaagcucgagagcaccaagaucuaccagauccuggccaucuacuccaccguggccagcucccugguccucguggugagccugggggcgaucagcuucuggaugugcuccaacggcagccugcagugccgcaucugcaucuga

SEQ ID NO: 72009 - RNA, 1701 nt, Artificial Sequence
  derived and/or modified sequence opt1 from hemagglutinin__InfluenzaA__AHG96330
augaaggccauccuggugguccuccuguacaccuucgccaccgcgacggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcacgaccgccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugagccucgccaccggccugcggaacgucccguccauccagagccgcgggcuguucggcgcgaucgccggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgcggugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacagcaacgugaagaaccucuacgagaagauccggaaccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgcgagaagaucgacggcgugaagcucgaguccacccggaucuaccagauccuggccaucuacagcaccguggcguccagccugguccucguggugagccugggggccaucuccuucuggaugugcagcaacggcucccugcagugccgcaucugcaucuga

SEQ ID NO: 72010 - RNA, 1701 nt, Artificial Sequence; identical to SEQ ID NO: 71048
  derived and/or modified sequence opt1 from hemagglutinin__InfluenzaA__AHG96332

SEQ ID NO: 72011 - RNA, 1701 nt, Artificial Sequence
  derived and/or modified sequence opt1 from hemagglutinin__InfluenzaA__AHG96334
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucaacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcugucccagagcuacaucaacgacaagggcaaggaggugcucguccugugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccucguggagcccggggacaagaucaccuucgaggcgacgggcaaccugguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcuccggcuggccaccggccugcgcaacgucccgagcauccagucccggggccucuucggggcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacagcgucaucgagaagaugaacacccaguucaccgcggugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagagcacccgcaucuaccagauccuggccaucuacuccaccgucgcgagcucccucgugcugguggucagccugggggccaucagcuucuggaugugcuccaacggcagccuccagugccggaucugcaucuga

SEQ ID NO: 72012 - RNA, 1701 nt, Artificial Sequence
  derived and/or modified sequence opt1 from hemagglutinin__InfluenzaA__AHG96335
augaaggccauccuggugguccuccuguacaccuucgagaccgccaacgcggacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgcgagcagcugagcuccgugagcuccuucgagcgguucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcaccacggcggaccagcagucccuguaccagaacgccgacgccuacguguucgugggcaccagccgcuacuccaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucaccauggagcggaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcgccucgccaccggccugcggaacgucccgagcauccagucccgcgggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgccgugggcaaggaguucaaccaccuggagaagcggaucgagaaccugaacaagaaggucgacgacggcuuccucgacaucuggaccuacaacgcggagcugcuggugcuccuggagaacgagcgcacgcuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucagcuucuggaugugcuccaacggcagccugcagugccgcaucugcaucuga

SEQ ID NO: 72013 - RNA, 1701 nt, Artificial Sequence
  derived and/or modified sequence opt1 from hemagglutinin__InfluenzaA__AHG96336
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcgggacugcaacaccacgugccagaccccggagggcgccaucaacaccagccugcccuuccagaacauccaccccaucaccaucgggaagugccccaaguacgugaaguccacgaagcugcgccucgccaccggccugcggaacgucccgagcauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgcgagcucccuggugcucguggucagccugggggccaucagcuucuggaugugcuccaacggcagccugcagugccgcaucugcaucuga

SEQ ID NO: 72014 - RNA, 1701 nt, Artificial Sequence
  derived and/or modified sequence opt1 from hemagglutinin__InfluenzaA__AHG96338
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcucgugaagaaggggaacuccuacccgaagcugagccagagcuacaucaacgacaagggcaaggaggugcugguccucugggggauccaccaccccuccaccacggccgaccagcagagccuguaccagaacgccgacgccuacguguucgugggcaccucccgguacagcaagaaguucaagcccgagaucgccauccgccccaagguccgggaccaggagggccgcaugaacuacuacuggacccugguggagccgggggacaagaucaccuucgaggcgacgggcaaccucguggucccccgguacgccuucaccauggagcgcaacgccggguccggcaucaucaucagcgacacccccgugcacgacugcaacaccacgugccagacccccgagggcgccaucaacaccucccugccguuccagaacauccaccccaucaccaucgggaagugccccaaguacgucaagagcacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggagaagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 72015 - RNA, 1701 nt, Artificial Sequence
  derived and/or modified sequence opt1 from hemagglutinin__InfluenzaA__AHG96339
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggagauccuggugcucugggggauccaccaccccagcaccacggccgaccagcagucccuguaccagaacgccgacgccuacgucuucgugggcaccagccgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 72016 - RNA, 1701 nt, Artificial Sequence; identical to SEQ ID NO: 71048
  derived and/or modified sequence opt1 from hemagglutinin__InfluenzaA__AHG96340

SEQ ID NO: 72017 - RNA, 1701 nt, Artificial Sequence
  derived and/or modified sequence opt1 from hemagglutinin__InfluenzaA__AHG96341
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagcaaguacuccaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucaccauggagcggaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcgccucgccaccggccugcggaacaucccgagcauccagucccgcgggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcggaucgagaaccugaacaagaagguggacgacggcuuccucgacaucuggaccuacaacgccgagcugcugguccuccuggagaacgagcgcacgcuggacuaccacgacuccaacgugaagaaccucuacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgagaagaucgacggcgugaagcucgagagcacccggaucuaccagauccuggccaucuacuccaccguggcgagcucccugguccucguggugagccugggggccaucagcuucuggaugugcuccaacggcagccugcagugccgcaucugcaucuga

SEQ ID NO: 72018 - RNA, 1701 nt, Artificial Sequence
  derived and/or modified sequence opt1 from hemagglutinin__InfluenzaA__AHG96342
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacaucccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacaugugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 72019 - RNA, 1701 nt, Artificial Sequence
  derived and/or modified sequence opt1 from hemagglutinin__InfluenzaA__AHG96343
augaaggccauccuggugguccuccuguacaccuucgccaccgcgacggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugagccaguccuacaucaacgacaagggcaaggaggugcugguccucugggggauccaccaccccagcacgaccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccggguccggcaucaucaucagcgacacccccgugcacgacugcaacacgaccugccagaccccggagggcgccaucaacaccucccugcccuuccagaacauccaccccaucacgaucgggaagugccccaaguacgucaagagcaccaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 72020 - RNA, 1701 nt, Artificial Sequence; identical to SEQ ID NO: 71048
  derived and/or modified sequence opt1 from hemagglutinin__InfluenzaA__AHG96344

SEQ ID NO: 72021 - RNA, 1701 nt, Artificial Sequence; identical to SEQ ID NO: 72011
  derived and/or modified sequence opt1 from hemagglutinin__InfluenzaA__AHG96345

SEQ ID NO: 72022 - RNA, 1701 nt, Artificial Sequence; identical to SEQ ID NO: 71048
  derived and/or modified sequence opt1 from hemagglutinin__InfluenzaA__AHG96346

SEQ ID NO: 72023 - RNA, 1701 nt, Artificial Sequence; identical to SEQ ID NO: 71048
  derived and/or modified sequence opt1 from hemagglutinin__InfluenzaA__AHG96347

SEQ ID NO: 72024 - RNA, 1701 nt, Artificial Sequence; identical to SEQ ID NO: 71048
  derived and/or modified sequence opt1 from hemagglutinin__InfluenzaA__AHG96348

SEQ ID NO: 72025 - RNA, 1701 nt, Artificial Sequence; identical to SEQ ID NO: 71048
  derived and/or modified sequence opt1 from hemagglutinin__InfluenzaA__AHG96349

SEQ ID NO: 72026 - RNA, 1701 nt, Artificial Sequence; identical to SEQ ID NO: 71048
  derived and/or modified sequence opt1 from hemagglutinin__InfluenzaA__AHG96350

SEQ ID NO: 72027 - RNA, 1701 nt, Artificial Sequence; identical to SEQ ID NO: 71048
  derived and/or modified sequence opt1 from hemagglutinin__InfluenzaA__AHG96351

SEQ ID NO: 72028 - RNA, 1701 nt, Artificial Sequence; identical to SEQ ID NO: 71048
  derived and/or modified sequence opt1 from hemagglutinin__InfluenzaA__AHG96352

SEQ ID NO: 72029 - RNA, 1701 nt, Artificial Sequence
  derived and/or modified sequence opt1 from hemagglutinin__InfluenzaA__AHG96353
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 72030 - RNA, 1701 nt, Artificial Sequence; identical to SEQ ID NO: 71048
  derived and/or modified sequence opt1 from hemagglutinin__InfluenzaA__AHG96354

SEQ ID NO: 72031 - RNA, 1701 nt, Artificial Sequence
  derived and/or modified sequence opt1 from hemagglutinin__InfluenzaA__AHG96355
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucaacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcugucccagagcuacaucaacgacaagggcaaggaggugcucguccugugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccucguggagcccggggacaagaucaccuucgaggcgacgggcaaccugguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcuccggcuggccaccggccugcgcaacgucccgagcauccagucccggggccucuucggggcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacagcgucaucgagaagaugaacacccaguucaccgcggugggcaaggaguucaaccagcuggagaagcgcaucgagaaccucaacaagaaggucgacgacggcuuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagagcacccgcaucuaccagauccuggccaucuacuccaccgucgcgagcucccucgugcugguggucagccugggggccaucagcuucuggaugugcuccaacggcagccuccagugccggaucugcaucuga

SEQ ID NO: 72032 - RNA, 1701 nt, Artificial Sequence; identical to SEQ ID NO: 70866
  derived and/or modified sequence opt1 from hemagglutinin__InfluenzaA__AHG96356

SEQ ID NO: 72033 - RNA, 1701 nt, Artificial Sequence
  derived and/or modified sequence opt1 from hemagglutinin__InfluenzaA__AHG96359
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacgacgagagcuucaacuggaccggcgugacccagaacgggaccuccagcuccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgugaccgacaacgaccagaucuuccuguacgcccaggcguccgggcggaucaccgugagcacgaagcgcagccagcagaccgucaucccgaacaucggcucccggccccgcauccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 72034 - RNA, 1701 nt, Artificial Sequence; identical to SEQ ID NO: 72033
  derived and/or modified sequence opt1 from hemagglutinin__InfluenzaA__AHG96371

SEQ ID NO: 72035 - RNA, 1701 nt, Artificial Sequence; identical to SEQ ID NO: 72033
  derived and/or modified sequence opt1 from hemagglutinin__InfluenzaA__AHG96383

SEQ ID NO: 72036 - RNA, 1698 nt, Artificial Sequence; identical to SEQ ID NO: 68801
  derived and/or modified sequence opt1 from hemagglutinin__InfluenzaA__AHG96395

SEQ ID NO: 72037 - RNA, 1701 nt, Artificial Sequence; identical to SEQ ID NO: 72033
  derived and/or modified sequence opt1 from hemagglutinin__InfluenzaA__AHG96407

SEQ ID NO: 72038 - RNA, 1701 nt, Artificial Sequence; identical to SEQ ID NO: 72033
  derived and/or modified sequence opt1 from hemagglutinin__InfluenzaA__AHG96419

SEQ ID NO: 72039 - RNA, 1701 nt, Artificial Sequence; identical to SEQ ID NO: 72033
  derived and/or modified sequence opt1 from hemagglutinin__InfluenzaA__AHG96431

SEQ ID NO: 72040 - RNA, 1701 nt, Artificial Sequence; identical to SEQ ID NO: 72033
  derived and/or modified sequence opt1 from hemagglutinin__InfluenzaA__AHG96443

SEQ ID NO: 72041 - RNA, 1701 nt, Artificial Sequence; identical to SEQ ID NO: 72033
  derived and/or modified sequence opt1 from hemagglutinin__InfluenzaA__AHG96455

SEQ ID NO: 72042 - RNA, 1701 nt, Artificial Sequence; identical to SEQ ID NO: 72033
  derived and/or modified sequence opt1 from hemagglutinin__InfluenzaA__AHG96467

SEQ ID NO: 72043 - RNA, 1701 nt, Artificial Sequence; identical to SEQ ID NO: 72033
  derived and/or modified sequence opt1 from hemagglutinin__InfluenzaA__AHG96479

SEQ ID NO: 72044 - RNA, 1701 nt, Artificial Sequence; identical to SEQ ID NO: 72033
  derived and/or modified sequence opt1 from hemagglutinin__InfluenzaA__AHG96491

SEQ ID NO: 72045 - RNA, 1701 nt, Artificial Sequence; identical to SEQ ID NO: 63364
  derived and/or modified sequence opt1 from hemagglutinin__InfluenzaA__AHG96503

SEQ ID NO: 72046 - RNA, 1698 nt, Artificial Sequence; identical to SEQ ID NO: 68801
  derived and/or modified sequence opt1 from hemagglutinin__InfluenzaA__AHG96515

SEQ ID NO: 72047 - RNA, 1698 nt, Artificial Sequence; identical to SEQ ID NO: 68801
  derived and/or modified sequence opt1 from hemagglutinin__InfluenzaA__AHG96527

SEQ ID NO: 72048 - RNA, 1698 nt, Artificial Sequence; identical to SEQ ID NO: 68801
  derived and/or modified sequence opt1 from hemagglutinin__InfluenzaA__AHG96539

SEQ ID NO: 72049 - RNA, 1698 nt, Artificial Sequence; identical to SEQ ID NO: 68801
  derived and/or modified sequence opt1 from hemagglutinin__InfluenzaA__AHG96551

SEQ ID NO: 72050 - RNA, 1698 nt, Artificial Sequence; identical to SEQ ID NO: 71981
  derived and/or modified sequence opt1 from hemagglutinin__InfluenzaA__AHG96563

SEQ ID NO: 72051 - RNA, 1698 nt, Artificial Sequence; identical to SEQ ID NO: 68801
  derived and/or modified sequence opt1 from hemagglutinin__InfluenzaA__AHG96575

SEQ ID NO: 72052 - RNA, 1698 nt, Artificial Sequence; identical to SEQ ID NO: 68801
  derived and/or modified sequence opt1 from hemagglutinin__InfluenzaA__AHG96587

SEQ ID NO: 72053 - RNA, 1698 nt, Artificial Sequence; identical to SEQ ID NO: 68801
  derived and/or modified sequence opt1 from hemagglutinin__InfluenzaA__AHG96599

SEQ ID NO: 72054 - RNA, 1698 nt, Artificial Sequence; identical to SEQ ID NO: 68801
  derived and/or modified sequence opt1 from hemagglutinin__InfluenzaA__AHG96611

SEQ ID NO: 72055 - RNA, 1698 nt, Artificial Sequence; identical to SEQ ID NO: 68801
  derived and/or modified sequence opt1 from hemagglutinin__InfluenzaA__AHG96623

SEQ ID NO: 72056 - RNA, 1698 nt, Artificial Sequence; identical to SEQ ID NO: 68801
  derived and/or modified sequence opt1 from hemagglutinin__InfluenzaA__AHG96635

SEQ ID NO: 72057 - RNA, 1698 nt, Artificial Sequence; identical to SEQ ID NO: 68801
  derived and/or modified sequence opt1 from hemagglutinin__InfluenzaA__AHG96647

SEQ ID NO: 72058 - RNA, 1698 nt, Artificial Sequence; identical to SEQ ID NO: 68801
  derived and/or modified sequence opt1 from hemagglutinin__InfluenzaA__AHG96659

SEQ ID NO: 72059 - RNA, 1698 nt, Artificial Sequence; identical to SEQ ID NO: 68801
  derived and/or modified sequence opt1 from hemagglutinin__InfluenzaA__AHG96671

SEQ ID NO: 72060 - RNA, 1698 nt, Artificial Sequence; identical to SEQ ID NO: 68801
  derived and/or modified sequence opt1 from hemagglutinin__InfluenzaA__AHG96683

SEQ ID NO: 72061 - RNA, 1701 nt, Artificial Sequence; identical to SEQ ID NO: 72033
  derived and/or modified sequence opt1 from hemagglutinin__InfluenzaA__AHG96695

SEQ ID NO: 72062 - RNA, 1701 nt, Artificial Sequence; identical to SEQ ID NO: 72033
  derived and/or modified sequence opt1 from hemagglutinin__InfluenzaA__AHG96707

SEQ ID NO: 72063 - RNA, 1701 nt, Artificial Sequence; identical to SEQ ID NO: 72033
  derived and/or modified sequence opt1 from hemagglutinin__InfluenzaA__AHG96719

SEQ ID NO: 72064 - RNA, 1701 nt, Artificial Sequence; identical to SEQ ID NO: 72033
  derived and/or modified sequence opt1 from hemagglutinin__InfluenzaA__AHG96731

SEQ ID NO: 72065 - RNA, 1701 nt, Artificial Sequence; identical to SEQ ID NO: 72033
  derived and/or modified sequence opt1 from hemagglutinin__InfluenzaA__AHG96743

SEQ ID NO: 72066 - RNA, 1701 nt, Artificial Sequence; identical to SEQ ID NO: 72033
  derived and/or modified sequence opt1 from hemagglutinin__InfluenzaA__AHG96755

SEQ ID NO: 72067 - RNA, 1701 nt, Artificial Sequence; identical to SEQ ID NO: 72033
  derived and/or modified sequence opt1 from hemagglutinin__InfluenzaA__AHG96767

SEQ ID NO: 72068 - RNA, 1701 nt, Artificial Sequence; identical to SEQ ID NO: 72033
  derived and/or modified sequence opt1 from hemagglutinin__InfluenzaA__AHG96779

SEQ ID NO: 72069 - RNA, 1701 nt, Artificial Sequence
  derived and/or modified sequence opt1 from hemagglutinin__InfluenzaA__AHG96791
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacgacgagagcuucaacuggaccggcgugacccagaacgggaccuccagcuccugcaagcgccggagcaacaacuccuucuucagccgccugaacuggcucacgcagcugaaguucaaguaccccgcccugaacgugaccaugcccaacaacgagaaguucgacaagcucuacaucuggggcguccaccaccccgugaccgacaacgaccagaucuuccuguacgcccaggcguccgggcggaucaccgugagcacgaagcgcagccagcagaccgucaucccgaacaucggcucccggccccgcauccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucaaccagaucaacgggaagcugaaccggcugaucggcaagaccaacgagaaguuccaccagaucgagaaggaguucuccgaggucgagcgccggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgcgagaacgccgaggacaugggcaacgggugcuucaagaucuaccacaagugcgacaacgccugcaucggcagcauccggaacgggaccuacgaccacgacgucuaccgcgacgaggcgcucaacaaccgguuccagaucaagggcguggagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 72070 - RNA, 1701 nt, Artificial Sequence; identical to SEQ ID NO: 72033
  derived and/or modified sequence opt1 from hemagglutinin__InfluenzaA__AHG96803

SEQ ID NO: 72071 - RNA, 1701 nt, Artificial Sequence; identical to SEQ ID NO: 72033
  derived and/or modified sequence opt1 from hemagglutinin__InfluenzaA__AHG96815

SEQ ID NO: 72072 - RNA, 1701 nt, Artificial Sequence; identical to SEQ ID NO: 72033
  derived and/or modified sequence opt1 from hemagglutinin__InfluenzaA__AHG96827

SEQ ID NO: 72073 - RNA, 1701 nt, Artificial Sequence; identical to SEQ ID NO: 72033
  derived and/or modified sequence opt1 from hemagglutinin__InfluenzaA__AHG96839

SEQ ID NO: 72074 - RNA, 1701 nt, Artificial Sequence; identical to SEQ ID NO: 72033
  derived and/or modified sequence opt1 from hemagglutinin__InfluenzaA__AHG96851

SEQ ID NO: 72075 - RNA, 1701 nt, Artificial Sequence; identical to SEQ ID NO: 72033
  derived and/or modified sequence opt1 from hemagglutinin__InfluenzaA__AHG96863

SEQ ID NO: 72076 - RNA, 1701 nt, Artificial Sequence; identical to SEQ ID NO: 72033
  derived and/or modified sequence opt1 from hemagglutinin__InfluenzaA__AHG96875

SEQ ID NO: 72077 - RNA, 1701 nt, Artificial Sequence; identical to SEQ ID NO: 72033
  derived and/or modified sequence opt1 from hemagglutinin__InfluenzaA__AHG96887

SEQ ID NO: 72078 - RNA, 1701 nt, Artificial Sequence; identical to SEQ ID NO: 72033
  derived and/or modified sequence opt1 from hemagglutinin__InfluenzaA__AHG96899

SEQ ID NO: 72079 - RNA, 1701 nt, Artificial Sequence; identical to SEQ ID NO: 72033
  derived and/or modified sequence opt1 from hemagglutinin__InfluenzaA__AHG96911

SEQ ID NO: 72080 - RNA, 1701 nt, Artificial Sequence; identical to SEQ ID NO: 72033
  derived and/or modified sequence opt1 from hemagglutinin__InfluenzaA__AHG96923

SEQ ID NO: 72081 - RNA, 1701 nt, Artificial Sequence; identical to SEQ ID NO: 72033
  derived and/or modified sequence opt1 from hemagglutinin__InfluenzaA__AHG96935

SEQ ID NO: 72082 - RNA, 1701 nt, Artificial Sequence; identical to SEQ ID NO: 72033
  derived and/or modified sequence opt1 from hemagglutinin__InfluenzaA__AHG96947

SEQ ID NO: 72083 - RNA, 1701 nt, Artificial Sequence; identical to SEQ ID NO: 72033
  derived and/or modified sequence opt1 from hemagglutinin__InfluenzaA__AHG96959

SEQ ID NO: 72084 - RNA, 1701 nt, Artificial Sequence; identical to SEQ ID NO: 72033
  derived and/or modified sequence opt1 from hemagglutinin__InfluenzaA__AHG96971

SEQ ID NO: 72085 - RNA, 1701 nt, Artificial Sequence; identical to SEQ ID NO: 72033
  derived and/or modified sequence opt1 from hemagglutinin__InfluenzaA__AHG96983

SEQ ID NO: 72086 - RNA, 1701 nt, Artificial Sequence; identical to SEQ ID NO: 72033
  derived and/or modified sequence opt1 from hemagglutinin__InfluenzaA__AHG96995

SEQ ID NO: 72087 - RNA, 1701 nt, Artificial Sequence; identical to SEQ ID NO: 72033
  derived and/or modified sequence opt1 from hemagglutinin__InfluenzaA__AHG97007

SEQ ID NO: 72088 - RNA, 1701 nt, Artificial Sequence; identical to SEQ ID NO: 72033
  derived and/or modified sequence opt1 from hemagglutinin__InfluenzaA__AHG97019

SEQ ID NO: 72089 - RNA, 1701 nt, Artificial Sequence; identical to SEQ ID NO: 72033
  derived and/or modified sequence opt1 from hemagglutinin__InfluenzaA__AHG97031

SEQ ID NO: 72090 - RNA, 1701 nt, Artificial Sequence; identical to SEQ ID NO: 72033
  derived and/or modified sequence opt1 from hemagglutinin__InfluenzaA__AHG97043

SEQ ID NO: 72091 - RNA, 1701 nt, Artificial Sequence
  derived and/or modified sequence opt1 from hemagglutinin__InfluenzaA__AHH00866
augaagaccaucaucgcccugagcuacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccagccuccgcucccugguggccagcuccggcacgcuggaguucaacaacgagagcuucaacuggaccggggucgcccagaacggcaccuccagcgcgugcaagcggcgcuccaucaagagcuucuucucccggcucaacuggcugcaccagcuggagaaccgcuaccccgcccucaacgugaccaugcccaacaacgacaaguucgacaagcuguacaucuggggcgugcaccaccccagcacggacuccgaccagaucagcgucuacgcccaggccagcgggcgggugaccguguccaccaagcgcagccagcagaccgucaucccgaacaucgggucccggcccugggugcgcggcaucagcucccggaucagcaucuacuggacgaucgugaaccccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacagcgaggggaccggccaggcggccgaccugaaguccacgcaggccgccaucaaccagaucaacgggaagcugaacaagcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucacggacagcgagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 72092 - RNA, 1701 nt, Artificial Sequence
  derived and/or modified sequence opt1 from hemagglutinin__InfluenzaA__AHH00870
augaagaccaucaucgcccugagcuacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccagccuccgcucccugguggccagcuccggcacgcuggaguucaacaacgagagcuucaacuggaccggggucgcccagaacggcaccuccagcgcgugcaagcggcgcuccaucaagagcuucuucucccggcucaacuggcugcaccagcuggagaaccgcuaccccgcccucaacgugaccaugcccaacaacgacaaguucgacaagcuguacaucuggggcgugcaccaccccagcacggacuccgaccagaucagcgucuacgcccaggccagcgggcgggugaccguguccaccaagcgcagccagcagaccgucaucccgaacaucgggucccggcccugggugcgcggcaucagcucccggaucagcaucuacuggacgaucgugaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacagcgaggggaccggccaggcggccgaccugaaguccacgcaggccgccaucaaccagaucaacgggaagcugaacaagcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucacggacagcgagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 72093 - RNA, 1701 nt, Artificial Sequence
  derived and/or modified sequence opt1 from hemagglutinin__InfluenzaA__AHJ57430
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugccgccugcggggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgcgagcagcugagcuccgugagcuccuucgagcgguucgagaucagccccaagaccuccagcuggcccaaccacgacuccaacaaggggguccgcgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcaccagccgguacuccaagaaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccgccagcggcaucaucaucuccgacacccccgugcacgacugcaacacgaccugccagaccccgaagggcgcggugaacaccagccugcccuuccagaacauccaccccaucacgaucgggaagugccccaaguacgucaaguccaccaagcugcggcucgccaccggccugcgcaacaucccgagcauccagucccgggggcuguucggcgccaucgccggguucaucgagggcggcuggaccgggaugguggacggcugguacggguaccaccaccagaacgagcagggcagcggguacgccgcggaccucaaguccacgcagaacgccaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcaacaacacgugcauggaguccgugaagaacgggaccuacgacuaccccaaguacagcgaggaggcgaagcugaaccgggagaagaucgacggcgugaagcucgaguccacccgcaucuaccagauccuggccaucuacagcaccgucgccagcucccuggugcucguggucagccugggggccaucuccuucuggaugugcagcaacggcucccugcagugccggaucugcaucuga

SEQ ID NO: 72094 - RNA, 1701 nt, Artificial Sequence
  derived and/or modified sequence opt1 from hemagglutinin__InfluenzaA__AHJ57431
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaaggggguccgggccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccuccgccgaccagcagagccuguaccagaacgccgacgccuacguguucgugggcaccucccgcuacagcaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcgccucgcgaccggccugcggaacaucccguccauccagagccgcgggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgugaucgagaagaugaacacccaguucaccgccgucggcaaggaguucaaccaccuggagaagcggaucgagaaccugaacaagaagguggacgacggcuuccucgacaucuggacguacaacgccgagcugcugguccuccuggagaacgagcgcacccuggacuaccacgacagcaacgugaagaaccucuacgagaaggugcggaaccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgcgagaagaucgacggcgugaagcucgaguccacccggaucuaccagauccuggcgaucuacagcaccguggccuccagccugguccucguggugagccugggggccaucuccuucuggaugugcagcaacggcucccugcagugccgcaucugcaucuga

SEQ ID NO: 72095 - RNA, 1701 nt, Artificial Sequence
  derived and/or modified sequence opt1 from hemagglutinin__InfluenzaA__AHJ57432
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagccccagaucgccauccgcccgaagguccgggaccaggagggccgcaugaacuacuacuggacccugguggagcccggggacaagaucaccuucgaggcgacgggcaaccucguggucccccgguacgccuucgcccuggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcuccggcuggcgacgggccugcgcaacgucccgagcauccagucccggggccucuucggggccaucgccggguucaucgagggcggcuggaccgggaugguggagggcugguacggguaccaccaccagaacgagcagggcagcggguacgccgccgaccugaaguccacccagaacgcgaucgacaagaucaccaacaaggugaacagcgucaucgagaagaugaacacgcaguucaccgccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagagcacccgcaucuaccagauccuggcgaucuacuccaccgucgccagcucccucgugcugguggucagccugggggccaucagcuucuggaugugcuccaacggcagccuccagugccggaucugcaucuga

SEQ ID NO: 72096 - RNA, 1701 nt, Artificial Sequence
  derived and/or modified sequence opt1 from hemagglutinin__InfluenzaA__AHJ57433
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaaggaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 72097 - RNA, 1701 nt, Artificial Sequence
  derived and/or modified sequence opt1 from hemagglutinin__InfluenzaA__AHJ57434
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacccccuggaggacaagcacaacgggaagcugugcaagcuccgcggcgucgccccgcugcaccuggggaagugcaacaucgccggcuggauccucgggaaccccgagugcgagagccuguccaccgcgagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggccgaaccacgacagcaacaagggggucaccgccgccugcccccacgccggcgcgaaguccuucuacaagaaccugaucuggcuggugaaggaggggaacagcuaccccaagcucuccaagagcuacaucaacgacaagggcaaggaggugcugguccugugggggauccaccaccccagcaccacggccgaccagcagucccucuaccagaacgccgacgccuacguguucgugggcaccagccgguacuccaagaaguucaagccggagaucgccauccgccccaagguccgggaccaggagggccgcaugaacuacuacuggacccugguggagcccggggacaagaucaccuucgaggcgacgggcaaccugguggucccccgguacgccuucgccauggagcgcaacgccgggagcggcaucaucaucuccgacaccccggugcacgacugcaacacgaccugccagacccccgagggcgccaucaacaccagccuccccuuccagaacauccaccccaucaccaucgggaagugcccgaaguacgugaaguccaccaagcugcggcuggcgacgggccuccgcaacguccccagcauccagucccgggggcuguucggcgccaucgccggguucaucgagggcggcuggaccgggaugguggacggcugguacggguaccaccaccagaacgagcagggcagcggguacgccgccgaccugaaguccacccagaacgcgaucgacaagaucaccaacaaggugaacagcgucaucgagaagaugaacacgcaguucaccgccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgcgaucuacuccaccgucgccagcucccuggugcugguggucagccucggggccaucagcuucuggaugugcuccaacggcagccugcagugccggaucugcaucuga

SEQ ID NO: 72098 - RNA, 1701 nt, Artificial Sequence
  derived and/or modified sequence opt1 from hemagglutinin__InfluenzaA__AHJ57435
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaaccgcggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucgccauggagcggaacgccgggagcggcaucaucaucuccgacacccccgugcacgacugcaacacgaccugccagaccccggagggcgccaucaacaccagccugcccuuccagaacauccaccccaucaccaucgggaagugccccaaguacgugaaguccaccaagcugcgccucgcgacgggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggcgaucuacuccaccgucgccagcucccuggugcucguggucagccugggggccaucagcuucuggaugugcuccaacggcagccugcagugccgcaucugcaucuga

SEQ ID NO: 72099 - RNA, 1701 nt, Artificial Sequence
  derived and/or modified sequence opt1 from hemagglutinin__InfluenzaA__AHJ57436
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccauccccaacaacgagcaguucgacaagcucuacaucuggggcguccaccaccccgggaccgacaaggaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagcugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcguggcccuccugggcuucaucaugugggccugccagaaggggaacauccggugcaacaucugcaucuga

SEQ ID NO: 72100 - RNA, 1701 nt, Artificial Sequence
  derived and/or modified sequence opt1 from hemagglutinin__InfluenzaA__AHJ57437
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacuccagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcaguccacccugaagcucgccaccggcaugcgcaacgugcccgagaagcagacgcgggggaucuucggcgcgaucgccggguucaucgagaacggcugggagggcaugguggacgggugguacggcuuccgccaccagaacagcgaggggcggggccaggccgccgaccugaaguccacccaggccgcgaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugaaggagaacgccgaggacauggggaacggcugcuucaagaucuaccacaagugcgacaacgccugcaucggguccauccgcaacggcaccuacgaccacgacgucuaccgcgacgaggcgcucaacaaccgguuccagaucaaggggguggagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72101 - RNA, 1701 nt, Artificial Sequence
  derived and/or modified sequence opt1 from hemagglutinin__InfluenzaA__AHJ57438
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacuccagcuucuucucccgccugaaguggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggacugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaccgggagcauccgcaacggcaccuacgaccacgacguguaccgggacgaggcccucaacaaccgcuuccagaucaagggggucgaggugaaguccggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 72102 - RNA, 1701 nt, Artificial Sequence
  derived and/or modified sequence opt1 from hemagglutinin__InfluenzaA__AHJ57651
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcacccucaacgagguggaggagcugaaggcccugaucggcagcggggagcgggucgagcgcuucgagauguuccccaaguccaccugggccggcguggacaccgacagcgggguguccagcgccugcccgcucggcaacgggcccuccuucuaccggaaccugcuguggaucaucaagcucaagagcuccgaguaccccgucauccgcggcacguucaacaacaccggcgacaagagcauccuguacuucuggggcgugcaccacccgcccgugaccaccgagcaggaggcgcuguacggguccggggaccgguacguccgcaugggcacggagagcaugaacuucgcccggucccccgagaucgccgcccgccccgccgugaacggccagcgggggcgcaucgacuacuucuggagcauccucaagcccggcgagacccugaacguggaguccaacgggaaccugaucgcgccgugguacgccuaccgguucgucaacaaggacagcaagggcgccaucuuccgcagcacccuccccaucgagaacugcgacgcgaccugccagacgaccgagggggugauccggaccaacaagaccuuccagaacgugagcccccuguggaucggcgagugccccaaguacgucaaguccaagucccugcgccucgccacgggccugcggaacgugccgcagaucgagacccgcgggcuguucggcgccaucgccggguucaucgagggcggguggaccggcaugaucgacggcugguacggguaccaccacgagaacagccagggcuccggguacgccgccgaccgggagagcacccagaaggccaucgacggcaucacgaacaaggugaacuccaucaucgacaagaugaacacccaguucgaggcggucgggcacgaguucagcaaccucgagcgccgcaucgacaaccugaacaagcggauggaggacggcuuccuggacguguggaccuacaacgccgagcuccuggugcugcucgagaacgagcgcacccuggacaugcacgacgccaacgucaagauccuguacgagaaggugcggucccagcuccgcgacaacgccaaggaccugggcaacgggugcuucgaguucuggcacaagugcgacaacgagugcaucgagagcgucaagaacggcacguacaacuaccccaaguaccaguccgagagccggcugaaccgccagaccaucgaguccgugaagcucgagaaccuggggguguaccagauccuggccaucuacagcaccgucuccagcucccucgugcuggugggccugauccucgcgaugggccuguggaugugcagcaacggguccaugcagugccggaucugcaucuga

SEQ ID NO: 72103 - RNA, 1701 nt, Artificial Sequence
  derived and/or modified sequence opt1 from hemagglutinin__InfluenzaA__AHJ57663
augaucgccuucaucgugaucgccacccuggucgcgaccggcaagagcgacaagaucugcaucggguaccacgccaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcacccucaacgaggccgaggagcugaaggcccugaucggcagcggggagcgggucgagcgcuucgagauguuccccaaguccaccuggacgggcguggacaccgagagcgggguguccagcgccugcccgcucggcaacgggcccuccuucuaccggaaccugcuguggaucaucaagcucaagagcuccgaguaccccgucauccgcggcaccuucaacaacaccggcgacaagagcauccuguacuucuggggcgugcaccacccgcccgugacgaccgagcagaacgcccuguacggguccggggaccgguacguccgcaugggcaccgagagcaugaacuucgcgcggucccccgagaucgccgcccgccccgccgugaacggccagcgggggcgcaucgacuacuucuggagcauccucaagcccggcgagacccugaacguggaguccaacgggaaccugaucgccccgugguacgcguaccgguucgucaacaaggacagcaagggcgccaucuuccgcagcaaccuccccaucgagaacugcgacgccacgugccagaccaccgagggggugauccggaccaacaagacguuccagaacgugagcccccuguggaucggcgagugccccaaguacgucaaguccaagucccugcgccucgccaccggccugcggaacgugccgcagaucgagacccgcgggcuguucggcgccaucgcgggguucaucgagggcggguggaccggcaugaucgacggcugguacggguaccaccacgagaacagccagggcuccggguacgccgccgacaaggagagcacgcagaaggccaucgacggcaucaccaacaaggugaacuccaucaucgacaagaugaacacccaguucgaggccgucgggcacgaguucagcaaccucgagcggcgcaucgacaaccugaacaagcgcauggaggacggcuuccuggacguguggaccuacaacgcggagcuccuggugcugcucgagaacgagcggacgcuggaccugcacgacgccaacgucaagaaccuccacgagcgcgugaagucccagcugcgggacaacgccaacgaccugggcaacgggugcuucgaguucuggcacaagugcgacaacgagugcauggagagcgucaagaacggcaccuacaacuaccccaaguaccaggccgagucccgccucaacaagcagaagaucgagagcgugaagcuggaggaguucgggguguaccagauccuggccaucuacuccaccgucagcuccagccucgugcuggugggccugaucauggcgaugggccucuggaugugccccaacggguccaugcagugccggaucugcaucuga

SEQ ID NO: 72104 - RNA, 1701 nt, Artificial Sequence
  derived and/or modified sequence opt1 from hemagglutinin__InfluenzaA__AHJ57674
augaucgccuucaucgugaucgccauccuggucaccaccggcaagagcgacaagaucugcaucggguaccacgcgaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcacccucaacgaggucgaggagcugaaggcccugaucggcagcggggagcggguggagcgcuucgagauguuccccaaguccaccugggccggcguggacacgaacagcggggucuccagcgccugcccgcucggcgaggggcccuccuucuaccggaaccugcuguggaucaucaagcacaccaccagcggcuaccccgugaucaagggcaccuaccgcaacacgggggacaaguccgugcucuacuucuggggcguccaccacccgcccgacaccaccgagcagaacgugcuguacgggagcggcaaccgguacgugcgcaugggcaccgaguccaugaacuucgcccggagccccgagaucgccgcgcgccccgccgucaacgggcagcggggccgcaucgacuacuucugguccauccugaagcccggggagacgcucaacguggagagcaacggcaaccugaucgccccgugguacgccuaccgguucgugaacaaggacuccaagggggccaucuuccgcagcaaccugcccaucgagaacugcgacgcgaccugccagaccaccgagggcgucauccggacgaacaagaccuuccagaacgugagcccccucuggaucggcgagugccccaaguacgugaaguccaagagccugcgccuggccaccgggcuccggaacgucccgcagaucgagacccgcggccuguucggggccaucgccggcuucaucgagggcggguggacgggcaugaucgacgggugguacggcuaccaccacgagaacucccaggggagcggcuacgccgcggaccgggaguccacccagaaggccaucgacgggaucaccaacaaggugaacagcaucaucgacaagaugaacacccaguucgaggccgugggccacgaguucuccaaccuggagcgccgcaucgacaaccucaacaagcggauggaggacggcuuccuggacgucuggacguacaacgccgagcugcucgugcugcuggagaacgagcgcacccucgaccugcacgacgccaacgucaagaaccugcacgagcgggugcgcagccagcuccgggacaacgcgaacgaccuggggaacggcugcuucgaguucuggcacaagugcgacaacgagugcauggaguccgugaagaacgggaccuacaacuaccccaaguaccaggccgagagccgccugaaccggcagaagaucgaguccgucaagcucgaggaguucggcguguaccagauccuggccaucuacagcaccguguccagcucccugguccucgugggccugaucauggccauggggcuguggaugugcagcaacggcuccaugcagugccgcaucugcaucuga

SEQ ID NO: 72105 - RNA, 1701 nt, Artificial Sequence
  derived and/or modified sequence opt1 from hemagglutinin__InfluenzaA__AHJ57686
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggagggccgcuucugcaagaucuccaacaaggcgccccucgaccugcgggacugcacgcuggagggguggauccucggcaacccgcgcugcgggauccugcuggccgaccagagcugguccuacaucguggagcggcccaacgcccgcaacggcaucugcuaccccggcauccucaacgaggccgaggagcugaaggcccugaucgggagcggcgagcggguggagcgcuucgagauguuccccaaguccaccugggccggggucgacaccaacagcggcguguccagcgcgugcccgcucgggaacggccccuccuucuaccggaaccugcuguggaucaucaagcucaagagcuccgccuaccccgugauccgcggcaccuucaacaacacgggggacaagagcauccuguacuucuggggcguccaccacccgcccguggccaccgagcaggaggcccuguacggguccggcaaccgguacgugcgcaugggcaccgagagcaugaacuucgcccggaaccccgagaucgcggcccgccccgccgucaacgggcagcggggccgcaucgacuacuucugguccauccucaagcccggggagacccugaacguggagagcaacggcaaccugaucgccccgugguacgccuaccgguucgugaacaaggacuccaagggggcgaucuuccgcagcaaccuccccaucgagaacugcgaggccacgugccagaccaccgagggcgucauccggaccaacaagacguuccagaacgugagcccccuguggaucggcgagugccccaaguacgugaaguccaagagccugcgccucgccaccgggcugcggaacgucccgcagaucgagacccgcggccuguucggggccaucgccggcuucaucgagggcggguggaccggcaugaucgacgggugguacggcuaccaccacgagaacucccaggggagcggcuacgcggccgaccgggaguccacgcagaaggccaucgacgggaucaccaacaaggugaacagcaucaucgacaagaugaacacccaguucgaggccgugggccacgaguucuccaaccucgagcgccgcaucgacaaccugaacaagcggauggaggacggcuuccuggacgucuggaccuacaacgccgagcuccuggugcugcucgagaacgagcgcacgcuggaccugcacgacgcgaacgugaagaaccuccacgagaagguccggagccagcugcgcgacaacgccaacgaccuggggaacggcugcuucgaguucuggcacaagugcgacaacgagugcauggaguccgugaagaacgggaccuacgacuaccccaaguaccaggccgagagccggcucaaccgccagaagaucgaguccgucaagcuggagaacuucgacguguaccagauccuggccaucuacagcaccguguccagcucccucguccuggugggccugaucauggcgaugggccucuggaugugcagcaacggguccaugcagugccggaucugcaucuga

SEQ ID NO: 72106 - RNA, 1701 nt, Artificial Sequence
  derived and/or modified sequence opt1 from hemagglutinin__InfluenzaA__AHJ57697
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcacccucaacgagguggaggagcugaaggcccugaucggcagcggggagcgggucgagcgcuucgagauguuccccaaguccaccugggccggcguggacaccaacagcgggguguccagcgccugcccgcucggcaacgggcccuccuucuaccggaaccugcuguggaucaucaagcucaagagcuccgaguaccccgucauccgcggcacguucaacaacaccggcgacaagagcauccuguacuucuggggcgugcaccacccgcccgugaccaccgagcaggaggcgcuguacggguccggggaccgguacguccgcaugggcacggagagcaugaacuucgcccggucccccgagaucgccgcccgccccgccgugaacggccagcgggggcgcaucgacuacuucuggagcauccucaagcccggcgagacccugaacguggaguccaacgggaaccugaucgcgccgugguacgccuaccgguucgucaacaaggacagcaagggcgccaucuuccgcagcaaccuccccaucgagaacugcgacgcgaccugccagaccacggagggggugauccggaccaacaagaccuuccagaacgugagcccccuguggaucggcgagugccccaaguacgucaaguccaagucccugcgccucgccaccggccugcggaacgugccgcagaucgagacgcgcgggcuguucggcgccaucgccggguucaucgagggcggguggaccggcaugaucgacggcugguacggguaccaccacgagaacagccagggcuccggguacgccgccgaccgggagagcacccagaaggccaucgacggcaucaccaacaaggugaacuccaucaucgacaagaugaacacgcaguucgaggcggucgggcacgaguucagcaaccucgagcgccgcaucgacaaccugaacaagcggauggaggacggcuuccuggacguguggaccuacaacgccgagcuccuggugcugcucgagaacgagcgcacccuggaccugcacgacgccaacgucaagaaccuccacgagaaggugaagucccagcugcgggacaacgccaacgaccugggcaacgggugcuucgaguucuggcacaagugcgacaacgagugcauggagagcgucaagaacggcaccuacgacuaccccaaguaccaggccgagucccgccucaaccggcagaagaucgagagcgugaagcuggagaacuucgacguguaccagauccuggcgaucuacuccacggucagcuccagccucgugcugguggggcugaucauggccaugggccucuggaugugcuccaacggcagcaugcagugccgcaucugcaucuga

SEQ ID NO: 72107 - RNA, 1701 nt, Artificial Sequence
  derived and/or modified sequence opt1 from hemagglutinin__InfluenzaA__AHJ57707
augaucgccuucaucgugaucgccauccuggucaccaccggcaagagcgacaagaucugcgugggguaccacgcgaacaacuccacgaccaagguggacaccauccucgagaagaacgucaccgugacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucgucgagcggcccaacgcccgcaacgggaucugcuaccccggcacccucaacgagguggaggagcugaaggcccugaucggcagcggggagcggguggagcgcuucgagauguuccccaaguccaccuggacgggcgucgacaccaacagcgggguguccagcgccugcccgcucggcgaggggcccuccuucuaccggaaccugcuguggaucaucaagcacaccaccagcggcuaccccgugaucaagggcacguaccgcaacaccggggacaaguccguccucuacuucuggggcgugcaccacccgcccgacaccaccgagcagaacgugcuguacgggagcggcaaccgguacguccgcaugggcacggaguccaugaacuucgcccggagccccgagaucgccgcccgccccgcggugaacgggcagcggggccgcaucgacuacuucugguccauccugaagcccggggagacccucaacguggagagcaacggcaaccugaucgccccgugguacgccuaccgguucgucaacaaggacuccaagggggccaucuuccgcagcaaccugcccaucgagaacugcgacgcgaccugccagaccacggagggcgugauccggaccaacaagaccuuccagaacgugagcccccucuggaucggcgagugccccaaguacgucaaguccaagagccugcgccuggccaccgggcuccggaacgugccgcagaucgagacgcgcggccuguucggggccaucgccggcuucaucgagggcggguggaccggcaugaucgacgggugguacggcuaccaccacgagaacucccaggggagcggcuacgccgccgaccgggaguccacccagaaggcgaucgacgggaucaccaacaaggugaacagcaucaucgacaagaugaacacgcaguucgaggccgucggccacgaguucuccaaccuggagcgccgcaucgacaaccucaacaagcggauggaggacggcuuccuggacguguggaccuacaacgccgagcugcucguccugcuggagaacgagcgcacccucgaccugcacgacgccaacgugaagaaccugcacgagcgggugcgcagccagcuccgggacaacgccaacgaccuggggaacggcugcuucgaguucuggcacaagugcgacaacgagugcauggaguccgucaagaacgggaccuacaacuaccccaaguaccaggcggagagccgccugaacaagcagaagaucgaguccgugaagcucgaggaguucggcguguaccagauccuggccaucuacagcacggucuccagcucccuggugcucgugggccugaucauggccauggggcuguggaugugcagcaacggcuccaugcagugccggaucugcaucuga

SEQ ID NO: 72108 - RNA, 1701 nt, Artificial Sequence
  derived and/or modified sequence opt1 from hemagglutinin__InfluenzaA__AHJ57719
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcugagcgaccaguccuggagcuacaucguggagcggcccaacgcccgcaacgggaucugcuaccccggcauccucaacgaggccgaggagcugaaggcccugaucggcuccggggagcggguggagcgcuucgagauguuccccaagagcaccugggccggcgucgacaccaacuccggggugagcuccgccugcccgcucggcaacgggcccagcuucuuccggaaccugcuguggaucaucaagcucaaguccagcaccuaccccgugauccgcggcacguucaacaacaccggcgacaaguccauccuguacuucuggggcguccaccaccccagcgugaccaccgagcaggaggcgcuguacggguccgggaaccgguacgugcgcaugggcacggagagcaugaacuucgcccgguccccggagaucgccgcccgccccgccgucaacggccagcgggggcgcaucgacuacuucuggagcauccucaagcccggcgagacccugaacguggagagcaacgggaaccugaucgcgcccugguacgccuaccgguucgugaacaaggacuccaagggcgccaucuuccgcagcaaccucccgaucgagaacugcgacgcgaccugccagaccaucgagggggucauccggacgaacaagaccuuccagaacgugagcccccuguggaucggcgagugccccaaguacgugaaguccaagucccugcgccucgccaccggccugcggaacgucccccagaucgagacccgcgggcuguucggcgccaucgccggguucaucgagggcggguggacgggcaugaucgacggcugguacggguaccaccacgagaacagccagggcuccggguacgccgacgacaaggagagcacccagaaggccaucgacggcaucaccaacaaggugaacuccaucaucgacaagaugaacacccaguucgaggccguggggcacgaguucagcaaccucgagcggcgcaucgacaaccugaacaagcgcauggaggacggcuuccuggacgucuggacguacaacgcggagcuccuggugcugcucgagaacgagcggacccuggaccugcacgacgccaacgugaagaaccuccacgagaagguccgcucccagcugcgggacaacgccaacgaccugggcaacgggugcuucgaguucuggcacaagugcgacaacgagugcauggagagcgugaagaacggcaccuacgacuacccgaaguaccaggccgagucccgccucaaccggcagaagaucgagagcgucaagcuggagaacuucgacguguaccagauccuggccaucuacuccaccgugagcuccagccucguccugguggggcugaucauggcgaugggccucuggaugugcuccaacggcagcaugcagugccgcaucugcaucuga

SEQ ID NO: 72109 - RNA, 1701 nt, Artificial Sequence
  derived and/or modified sequence opt1 from hemagglutinin__InfluenzaA__AHJ57731
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcagcggggagcggguggagcgcuucgagauguuccccaaguccaccugggccggcgucgacaccgacagcgggguguccagcgcgugcccgcucggcaacgggcccuccuucuaccggaaccugcuguggaucaucaagcucaagagcuccgaguaccccgugauccgcggcaccuucaacaacacgggcgacaagagcauccuguacuucuggggcguccaccacccgcccgugaccaccgagcaggaggcccuguacggguccgggaaccgguacgugcgcaugggcaccgagagcaugaacuucgcccggucccccgagaucgccgcccgccccgcggucaacggccagcgggggcgcaucgacuacuucuggagcauccucaagcccggcgagacgcugaacguggaguccaacgggaaccugaucgccccgugguacgccuaccgguucgugaacaaggacagcaagggcgccaucuuccgcagcaaccuccccaucgagaacugcgacgcgaccugccagaccaccgagggggucauccggacgaacaagaccuuccagaacgugagcccccuguggaucggcgagugccccaaguacgugaaguccaagucccugcgccucgccaccggccugcggaacgucccgcagaucgagacccgcgggcuguucggcgccaucgccggguucaucgagggcggguggacgggcaugaucgacggcugguacggguaccaccacgagaacagccagggcuccggguacgccgccgaccgggagagcacccagaaggcgaucgacggcaucaccaacaaggugaacuccaucaucgacaagaugaacacccaguucgaggccguggggcacgaguucagcaaccucgagcgccgcaucgacaaccugaacaagcggauggaggacggcuuccuggacgucuggacguacaacgccgagcuccuggugcugcucgagaacgagcgcacccuggaccugcacgacgccaacgugaagaaccuccacgagaagguccggucccagcugcgcgacaacgccaacgaccugggcaacgggugcuucgaguucuggcacaagugcgacaacgagugcauggagagcgugaagaacggcaccuacgacuaccccaaguaccagaccgagucccggcucaaccgccagaagaucgagagcgucaagcuggagaacuucgacguguaccagauccuggcgaucuacuccacggugagcuccagccucguccugguggggcugaucauggccaugggccucuggaugugcuccaacggcagcaugcagugccggaucugcaucuga

SEQ ID NO: 72110 - RNA, 1701 nt, Artificial Sequence
  derived and/or modified sequence opt1 from hemagglutinin__InfluenzaA__AHJ57743
augaucgccuucaucgugaucgccauccuggucgcgaccggcaagagcgacaagaucugcaucggguaccacgccaacaacuccaccacgaagguggacaccauccucgagaagaacgugaccgucacccacagcguggagcugcuggagaaccagaaggaggagcgcuucugcaagaucuccaacaaggcgccccucgaccugcgggacugcacgaucgagggcuggauccuggggaacccgcgcugcggcauccuccuggccgaccagagcugguccuacaucguggagcggcccgacgcccgcaacgggaucugcuaccccggcacccugaacgaggccgaggagcucaaggcccugaucggcagcggggagaaggucgagcgguucgagauguuccccaaguccaccugggccggcguggacaccagcuccggggugagcuccgccugcccgcugggcaacgggcccagcuucuaccgcaaccuccuguggaucaucaagcugaaguccagcgaguaccccgucauccggggcacguucaacaacaccggcgacaaguccgugcucuacuucuggggcgugcaccacccgcccgucaccaccgagcagaacgcgcuguacgggagcgggaaccgcuacgugcggaugggcacggaguccaugaacuucgcccgcagccccgagaucgccgcccggcccgccgugaacggccagcgcgggcggaucgacuacuucugguccauccugaagcccggcgagacccucaacgucgagagcaacgggaaccugaucgcgccgugguacgccuaccgcuucgugaacaaggacagcaagggcgccaucuuccgguccaaccugcccaucgagaacugcgacgcgaccugccagaccaucgagggggugauccgcacgaacaagaccuuccagaacgucagcccccucuggaucggcgagugccccaaguacgugaaguccaagagccugcggcuggccaccggccuccgcaacgugccgcagaucgagacccgggggcuguucggcgccaucgccggguucaucgagggcggguggacgggcaugaucgacggcugguacggguaccaccacgagaacucccagggcagcggguacgccgccgaccgcgaguccacccagaaggccaucgacggcaucaccaacaaggucaacagcaucaucgacaagaugaacacccaguucgaggcggccgggcacgaguucuccaaccuggagcggcgcaucgacaaccucaacaagcgcauggaggacggcuuccuggacguguggacguacaacgccgagcugcucgugcugcuggagaacgagcggacccucgaccugcacgacgccaacgucaagaaccugcacgagaaggucaagagccagcuccgcgacaacgccaacgaccugggcaacgggugcuucgaguucuggcacaagugcgacaacgagugcauggaguccgugaagaacggcaccuacgacuaccccaaguaccagaaggagagccggcugaaccgccagaagaucgaguccgugaagcucgagaacuucgacguguaccagauccuggcgaucuacagcaccgucuccagcucccuggugcucguggggcugaucauggccaugggccuguggaugugcagcaacggcuccaugcagugccggaucugcaucuga

SEQ ID NO: 72111 - RNA, 1701 nt, Artificial Sequence
  derived and/or modified sequence opt1 from hemagglutinin__InfluenzaA__AHJ57755
augaucgccuucaucgugaucgccauccuggucgcgaccggcaagagcgacaagaucugcaucggguaccacgccaacaacuccaccacgaagguggacaccauccucgagaagaacgugaccgucacccacagcguggagcugcuggagaaccagaaggaggagcgcuucugcaagaucuccaacaaggcgccccucgaccugcgggacugcacgaucgagggcuggauccuggggaacccgcgcugcgacauccuccuggccgaccagagcugguccuacaucguggagcggcccaacgcccgcaacggcaucugcuaccccgggacccugaacgaggccgaggagcucaaggcccugaucggcagcggcgagggggucgagcgguucgagauguuccccaaguccaccugggugggcguggacaccagcuccggggucagcuccgccugcccgcugggcaacgggcccagcuucuaccgcaaccuccuguggaucaucaagcugaaguccagcgaguaccccgugauccggggcacguucaacaacaccggcgacaaguccgugcucuacuucuggggcguccaccacccgcccgugaccaccgagcagaacgcccuguacgggagcgggaaccgcuacgugcggaugggcacggaguccaugaacuucgcgcgcagccccgagaucgccgcccggcccgccgucaacggccagcgcgggcggaucgacuacuucugguccauccugaagcccggcgagacccucaacguggagagcaacgggaaccugaucgccccgugguacgcguaccgcuucgugaacaaggacaacaagggcgccaucuuccggagcaaccugcccaucgagaacugcgacgcgaccugccagaccacggagggggucauccgcaccaacaagaccuuccagaacgugagcccccucuggaucggcgagugccccaaguacgugaaguccaagucccugcggcuggccaccggccuccgcaacgucccgcagaucgagacgcgggggcuguucggcgccaucgccggguucaucgagggcggguggaccggcaugaucgacggcugguacggguaccaccacgagaacagccagggcuccggguacgccgccgaccgcgagagcacccagaaggccaucgacggcaucaccaacaaggugaacuccaucaucgacaagaugaacacgcaguucgaggccgcggggcacgaguucagcaaccuggagcggcgcaucgacaaccucaacaagcgcauggaggacggcuuccuggacguguggaccuacaacgccgagcugcucguccugcuggagaacgagcggacccucgaccugcacgacgccaacgugaagaaccugcacgagaaggucaagucccagcuccgcgacaacgccaacgaccugggcaacgggugcuucgaguucuggcacaagugcgacaacgagugcauggagagcgugaagaacggcaccuacgacuaccccaaguaccagaaggagucccggcugaaccgccagaagaucgagagcgugaagcucgagaacuucgacgucuaccagauccuggccaucuacuccacggugagcuccagccugguggucguggggcucaucauggcgaugggccuguggaugugcuccaacggcagcaugcagugccggaucugcaucuga

SEQ ID NO: 72112 - RNA, 1701 nt, Artificial Sequence
  derived and/or modified sequence opt1 from hemagglutinin__InfluenzaA__AHJ57767
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcacccucaacgagguggaggagcugaaggcccugaucggcagcggggagcgggucgagcgcuucgagauguuccccaaguccaccugggccggcguggacaccaacagcgggguguccagcgccugcccgcucggcaacgggcccuccuucuaccggaaccugcuguggaucaucaagcucaagagcuccgaguaccccgucauccgcggcacguucaacaacaccggcgacaagagcauccuguacuucuggggcgugcaccacccgcccgugaccaccgagcaggaggcgcuguacggguccggggaccgguacguccgcaugggcacggagagcaugaacuucgcccggucccccgagaucgccgcccgccccgccgugaacggccagcgggggcgcaucgacuacuucuggagcauccucaagcccggcgagacccugaacguggaguccaacgggaaccugaucgcgccgugguacgccuaccgguucgucaacaaggacagcaagggcgccaucuuccgcagcaaccuccccaucgagaacugcgacgcgaccugccagaccacggagggggugauccggaccaacaagaccuuccagaacgugagcccccuguggaucggcgagugccccaaguacgucaaguccaagucccugcgccucgccaccggccugcggaacgugccgcagaucgagacgcgcgggcuguucggcgccaucgccggguucaucgagggcggguggaccggcaugaucgacggcugguacggguaccaccacgagagcucccagggcagcggguacgccgccgacaaggaguccacccagaaggccaucgacggcaucaccaacaaggugaacagcaucaucgacaagaugaacacgcaguucgaggcggucgggcacgaguucuccaaccucgagcggcgcaucgacaaccugaacaagcgcauggaggacggcuuccuggacguguggaccuacaacgccgagcuccuggugcugcucgagaacgagcggacccuggaccugcacgacgccaacgucaagaaccuccacgagaaggugcgcagccagcugcgggacaacgccaacgaccugggcaacgggugcuucgaguucuggcacaagugcaacaacgagugcauggaguccgucaagaacggcaccuacgacuaccccaaguaccagaaggagagccgccucaaccggcagaagaucgaguccgugaagcuggagaacuucgacguguaccagauccuggccaucuacagcacggucuccagcucccucgugcugguggggcugauccucgcgaugggccuguggaugugcagcaacggcuccaugcagugccgcaucugcaucuga

SEQ ID NO: 72113 - RNA, 1701 nt, Artificial Sequence
  derived and/or modified sequence opt1 from hemagglutinin__InfluenzaA__AHJ57779
augaucgccaucaucaucaucgccauccugguggcgaccggcaagagcgacaagaucugcaucggguaccacgccaacaacuccaccacgaaggucgacaccauccucgagaagaacgugaccgugacccacagcgucgagcugcuggaggaccagaaggaggagcgcuucugcaagaucuccaacaaggcgccccucgaccugcgggacugcacgaucgagggcuggauccuggggaacccgcgcugcggcauccuccuggccgaccagagcugguccuacaucguggagcggcccaacgcccgcaacgggaucugcuaccccggcacccugaacgaggccgaggagcucaaggcccugaucggcagcggggagggcguggagcgguucgagauguuccccaaguccaccugggccggggucgacaccaacagcggcguguccagcgccugcccgcuggggaacggccccuccuucuaccgcaaccuccuguggaucaucaagcugaaguccuccgaguaccccgugauccggggcacguucaacaacaccggggacaagagcguccucuacuucuggggcgugcaccacccgcccgugaccaccgagcagaacgcgcuguacggguccggcaaccgcuacguccggaugggcacggagagcaugaacuucgcccgcucccccgagaucgccgcccggcccgccgugaacgggcagcgcggccggaucgacuacuucuggagcauccugaagcccggggagacccucaacguggaguccaacggcaaccugaucgcgccgugguacgccuaccgcuucgucaacaaggacagcaagggggccaucuuccggagcaaccugcccaucgagaacugcgacgcgaccugccagaccacggagggcgugauccgcaccaacaagaccuuccagaacgugagcccccucuggaucggcgagugccccaaguacgucaagagcaagucccugcggcuggccaccgggcuccgcaacgugccgcagaucgagacgcggggccuguucggggccaucgccggcuucaucgagggcggguggaccggcaugaucgacgggugguacggcuaccaccacgagaacagccagggguccggcuacgccgccgaccgcgagagcacccagaaggccaucgacgggaucaccaacaaggugaacuccaucaucgacaagaugaacacgcaguucgaggcggccggccacgaguucagcaaccuggagcggcgcaucgacaaccucaacaagcgcauggaggacggcuuccuggacgucuggaccuacaacgccgagcugcucgugcugcuggagaacgagcggacccucgaccugcacgacgccaacgugaagaaccugcacgagaaggucaagucccagcuccgcgacaacgccaacgaccuggggaacggcugcuucgaguucuggcacaagugcgacaacgagugcauggagagcgugaagaacgggaccuacgacuaccccaaguaccagaaggagucccggcugaaccgccagaagaucgagagcgucaagcucgagaacuucgacguguaccagauccuggcgaucuacuccacggugagcuccagccugguccucgugggccugaucauggccaugggccuguggaugugcuccaacgggagcaugcagugcaugaucugcaucuga

SEQ ID NO: 72114 - RNA, 1701 nt, Artificial Sequence
  derived and/or modified sequence opt1 from hemagglutinin__InfluenzaA__AHJ57791
augaucgccaucaucaucaucgccauccuggugaccaccggcaagagcgacaagaucugcaucggguaccacgcgaacaacuccacgaccaaggucgacaccauccucgagaagaacgugaccgugacgcacagcgucgagcugcuggagaacaagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcacccucaacgaggugaaggagcugaaggcccugaucggcagcggggagcgggucaagcgcuucgagauguuccccaaguccaccugggccggcguggacacgaacagcgggguguccagcuccugcccgcucggcaacgggcccagcuucuaccggaaccugcuguggaucaucaagcacaccaccuccggcuaccccgucaucaagggcaccuacacgaacaccggggacaagagcgugcucuacuucuggggcauccaccacccgcccgacaccaccgagcagaacgugcuguacggguccggcaaccgcuacguccggaugggcacggagagcaugaacuucgcccgcucccccgagaucgccgcccggcccgcggugaacgggcagcgcggccggaucgacuacuucuggagcauccugaagcccggggagacccucaacguggaguccaacggcaaccugaucgccccgugguacgccuaccgcuucgucaacaaggacagcaagggggccaucuuccggagcaaccugcccaucgaggacugcgacgcgaccugccagaccacggagggcgugauccgcaccaacaagaccuuccagaacgugagcccccucuggaucggcgagugccccaaguacgucaaguccaagucccugcggcuggccaccgggcuccgcaacgugccgcagaucgagacgcggggccuguucggggccaucgccggcuucaucgagggcggguggaccggcaugaucgacgggugguacggcuaccaccacgagaacagccagggguccggcuacgccgccgaccgcgagagcacccagaaggcgaucgacgggaucaccaacaaggugaacuccaucaucgacaagaugaacacgcaguucgaggccgucggccacgaguucagcaaccuggagcggcgcaucgacacccucaacaagcgcauggaggacggcuuccuggacguguggaccuacaacgccgagcugcucgugcugcuggagaacgagcggacccucgaccugcacgacgccaacgucaagaaccugcacgagcgcgugaagucccagcuccgggacaacgccaacgaccuggggaacggcugcuucgaguucuggcacaagugcgacaacgagugcauggagagcgucaagaacgggacguacaacuaccccaaguaccaggcggagucccgccugaacaagcagaagaucgagagcgugaagcucgaggaguucggcguguaccagauccuggccaucuacuccaccgucagcuccagccuggugcucgugggccugaucauggccaugguccuguggaugugcuccaacgggagcaugcagugccgggugugcaucuga

SEQ ID NO: 72115 - RNA, 1701 nt, Artificial Sequence
  derived and/or modified sequence opt1 from hemagglutinin__InfluenzaA__AHJ57815
augaucgccuucaucaucaucaccauccuggugaccacgggcaagagcgacaagaucugcaucggguaccacgccaacaacuccaccaccaaggucgacaccauccucgagaagaacgugacggugacccacagcgucgagcugcuggagaaccagaaggaggagcgcuucugccggaucuccaacaaggcgccccucgaccugaaggagugcacccuggagggcuggauccucgggaacccgcagugcgaccugcugcucggcgaccagagcugguccuacaucguggagcgccccaacgcccggaacgggaucugcuaccccggcacccugaacgagguggaggagcugcgcgcccucaucggcagcggggagggcgucgagcgguucgagauguuccccaaguccacgugggccgggguggacaccaaccgcggcgugaccagcuccugcccguucgggagcggcuccagcuucuaccggaaccugcuguggaucgucaagcacaccacguccagcuaccccgugaucaagggcaccuuccgcaacaccggggacaaguccgugcucuacuucuggggcguccaccaccccuucgacaccaacgagcagaacgugcuguacgggagcggcaaccgguacgugcgcaugggcacggaguccaugaacuucgcccgggggcccgaggucgcggcccgcccgguggugaacggccagcgggggcgcaucgacuacuucuggagcauccugaagcccggcgagacccucaacaucgaguccaacgggaaccugaucgcccccugguacgccuaccgguucgucaacaaggacagcaagggcgcgaucuuccgcagcaaccugcccaucgaggacugcgacgcgaccugccagaccaucgagggcgugauccggacgaacaagaccuuccagaacguguccccgcucuggaucggggagugccccaaguacgucaagagcgagucccugcgccuggccaccggccuccggaacgugccccagaucgagacccgcgggcuguucggcgccaucgccggguucaucgagggcggcuggacggggaugaucgacggcugguacggguaccaccacgagaacagccagggcuccggguacgccgccgaccgggagagcacccagaaggccaucgacggcaucaccaccaaggugaacuccaucaucgacaagaugaacacgcaguucgaggccgucggccacgaguucagcaaccuggagcgccgcaucgacaaccucaacaagcggcuggaggacggguuccuggacguguggaccuacaacgccgagcuccugguccugcucgagaacgagcgcacccuggaccugcacgacgcgaacgugaagaaccuccacgagcgggugcgcucccagcugcgggacaacgccaacgaccugggcaacgggugcuucgaguucuggcacaagugcgacaacgagugcauggagagcgucaagaacggcaccuacaacuaccccaaguaccaggccgagucccgccucaacaagcagcggaucgagagcgugaagcuggagaacuucgacguguaccagauccuggccaucuacuccacggucagcuccagccucgugcuggugggccugauccucgccauggggcuguggaugugcuccaacggcagcaugcagugccgcaucugcaucuga

SEQ ID NO: 72116 - RNA, 1701 nt, Artificial Sequence
  derived and/or modified sequence opt1 from hemagglutinin__InfluenzaA__AHJ57827
augaucgccuucaucgugaucgccauccuggucgcgaccggcaagagcgacaagaucugcaucggguaccacgccaacaacuccaccacgaagguggacaccauccucgagaagaacgugaccgucacccacagcguggagcugcuggagaaccagaaggaggagcgcuucugcaagaucuccaacaaggcgccccucgaccugcgggacugcacgaucgagggcuggauccuggggaacccgcgcugcggcauccuccuggccgaccagagcugguccuacaucguggagcggcccaacgcccgcaacgggaucugcuaccccggcacccugaacgaggucgaggagcucaaggcccugaucggcagcggggagcggguggagcgcuucgagauguuccccaaguccaccugggccggcguggacaccaacagcggggucuccagcgccugcccgcugggcaacgggcccuccuucuaccggaaccuccuguggaucaucaagaccaagagcuccgaguaccccgugaucaagggcaccuucaacaacaccggcgacaagagcgugcuguacuucuggggcguccaccacccgcccucccgcaacgagcagaacgugcucuacgggagcggggaccgguacgugcgcaugggcaccgaguccaugaacuucgcccggagccccgagaucgcggcccgccccgccgucaacggccagcgggggcgcaucgacuacuucugguccauccugaagcccggcgagacgcugaacguggagagcaacgggaaccucaucgccccgugguacgccuaccgguucgugaacaaggacagccgcggcgcgaucuuccgguccaaccugcccaucgagaacugcgacgccacgugccagaccgccgagggggucauccgcaccaacaagacguuccagaacgugagcccccuguggaucggcgagugccccaaguacgugaaguccaagagccuccggcuggccaccggccugcgcaacgucccgcagaucgagacccggggccucuucggggccaucgcgggguucaucgagggcggguggaccggcaugaucgacggcugguacggguaccaccacgagaacucccagggcagcggguacgccgccgaccgcgaguccacgcagaaggccaucgacggcaucaccaacaaggugaacagcaucaucgacaagaugaacacccaguucgaggccguggggcacgaguucuccaaccuggagcgccggaucgacaaccugaacaagcgcauggaggacggcuuccucgacgucuggaccuacaacgcggagcugcuggugcuccuggagaacgagcggacgcuggaccuccacgacgccaacgucaagaaccugcacgagcgcgucaagagccagcugcgggacaacgccaacgaccucggcaacgggugcuucgaguucuggcacaagugcgacaacgagugcauggaguccgugaagaacggcaccuacgacuaccccaaguaccagaaggagagccgccugaaccggcagaagaucgaguccgugaagcuggagaacuucgacguguaccagauccucgccaucuacagcaccguguccagcucccugguccugguggggcucaucauggccaugggccuguggaugugcagcaacggcuccaugcagugccgcaucugcaucuga

SEQ ID NO: 72117 - RNA, 1701 nt, Artificial Sequence
  derived and/or modified sequence opt1 from hemagglutinin__InfluenzaA__AHJ57850
augaucgccuucaucgugaucgccauccuggcgaccaccggcaagagcgacaagaucugcaucggguaccacgccaacaacuccacgaccaaggucgacaccauccucgagaagaacgugaccgugacgcacagcgucgagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcagcggggagcggguggagcgcuucgagauguuccccaaguccaccugggccggcgucgacaccgacagcgggguguccagcgccugcccgcucggcaacgggcccuccuucuaccggaaccugcuguggaucaucaagcucaagagcuccgaguaccccgugauccgcggcacguucaacaacaccggcgacaagagcauccuguacuucuggggcguccaccacccgcccgugaccaccgagcaggaggcgcuguacggguccgggaaccgguacgugcgcaugggcacggagagcaugaacuucgcccggacccccgagaucgccgcccgccccgccgucaacggccagcgggggcgcaucgacuacuucugguccauccucaagcccggcgagacccugaacguggagagcaacgggaaccugaucgcgccgugguacgccuaccgguucgugaacaaggacuccaagggcgccaucuuccgcagcaaccuccccaucgagaacugcgacgcgaccugccagacgaccgagggggucauccggaccaacaagaccuuccagaacgugagcccccuguggaucggcgagugccccaaguacgugaaguccaagagccugcgccucgccacgggccugcggaacgucccgcagaucgagacccgcgggcuguucggcgccaucgccggguucaucgagggcggguggaccggcaugaucgacggcugguacggguaccaccacgagaacucccagggcagcggguacgccgccgaccgggaguccacccagaaggccaucgacggcaucacgaacaaggugaacagcaucaucgacaagaugaacacccaguucgaggcgguggggcacgaguucuccaaccucgagcgccgcaucgacaaccugaacaagcggauggaggacggcuuccuggacgucuggaccuacaacgccgagcuccuggugcugcucgagaacgagcgcacccuggaccugcacgacgccaacgugaagaaccuccacgagaagguccggagccagcugcgcgacaacgccaacgaccugggcaacgggugcuucgaguucuggcacaagugcgacaacgagugcauggaguccgugaagaacggcacguacgacuaccccaaguaccaggccgagagccggcucaaccgccagaagaucgaguccgucaagcuggagaacuucgacguguaccagauccuggcgaucuacagcaccguguccagcucccucguccugguggggcugaucauggccaugggccucuggaugugcagcaacggcuccaugcagugccggaucugcaucuga

SEQ ID NO: 72118 - RNA, 1701 nt, Artificial Sequence
  derived and/or modified sequence opt1 from hemagglutinin__InfluenzaA__AHJ57862
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcagcggggagcggguggagcgcuucgagauguuccccaaguccaccugggccggcgucgacaccaacagcgggguguccagcgcgugcccgcucggcaacgggcccuccuucuaccggaaccugcuguggaucaucaagcucaagagcuccgaguaccccgugauccgcggcaccuucaacaacacgggcgacaagagcauccuguacuucuggggcguccaccacccgcccgugaccaccgagcaggaggcccuguacggguccgggaaccgguacgugcgcaugggcaccgagagcaugaacuucgcccggucccccgagaucgccgcccgccccgcggucaacggccagcgggggcgcaucgacuacuucuggagcauccucaagcccggcgagacgcugaacguggaguccaacgggaaccugaucgccccgugguacgccuaccgguucgugaacaaggacagcaagggcgccaucuuccgcagcaaccuccccaucgagaacugcgacgcgaccugccagaccaccgagggggucauccggacgaacaagaccuuccagaacgugagcccccuguggaucggcgagugccccaaguacgugaaguccaagucccugcgccucgccaccggccugcggaacgucccgcagaucgagacccgcgggcuguucggcgccaucgccggguucaucgagggcggguggacgggcaugaucgacggcugguacggguaccaccacgagaacagccagggcuccggguacgccgccgaccgggagagcacccagaaggcgaucgacggcaucaccaacaaggugaacuccaucaucgacaagaugaacacccaguucgaggccguggggcacgaguucagcaaccucgagcgccgcaucgacaaccugaacaagcggauggaggacggcuuccuggacgucuggacguacaacgccgagcuccuggugcugcucgagaacgagcgcacccuggaccugcacgacgccaacgugaagaaccuccacgagaagguccggucccagcugcgcgacaacgccaacgaccugggcaacgggugcuucgaguucuggcacaagugcgacaacgagugcauggagagcgugaagaacggcaccuacgacuaccccaaguaccaggcggagucccggcucaaccgccagaagaucgagagcgucaagcuggagaacuucgacguguaccagauccuggccaucuacuccaccgugagcuccagccucguccugguggggcugaucauggccaugggccucuggaugugcuccaacggcagcaugcagugccggaucugcaucuga

SEQ ID NO: 72119 - RNA, 1701 nt, Artificial Sequence
  derived and/or modified sequence opt1 from hemagglutinin__InfluenzaA__AHJ57873
augaucgccuucaucgugaucgccacccuggucgcgaccggcaagagcgacaagaucugcaugggguaccacgccaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcacccucaacgaggccgaggagcugaaggcccugaucggcagcggggagcgggucgagcgcuucgagauguuccccaaguccaccuggacgggcguggacaccgagagcgggguguccagcgccugcccgcucggcaacgggcccuccuucuaccggaaccugcuguggaucaucaagcucaagagcuccgaguaccccgucauccgcggcaccuucaacaacaccggcgacaagagcauccuguacuucuggggcgugcaccacccgcccgugacgaccgagcagaacgcccuguacggguccggggaccgguacguccgcaugggcaccgagagcaugaacuucgcgcggucccccgagaucgccgcccgccccgccgugaacggccagcgggggcgcaucgacuacuucuggagcauccucacccccggcgagacgcugaacguggaguccaacgggaaccugaucgccccgugguacgcguaccgguucgucaacaaggacagcaagggcgccaucuuccgcagcaaccuccccaucgagaacugcgacgcgaccugccagaccaccgagggggugauccggacgaacaagaccuuccagaacgugagcccccuguggaucggcgagugccccaaguacgucaaguccaagucccugcgccucgccaccggccugcggaacgugccgcagaucgagacccgcgggcuguucggcgccaucgccggguucaucgagggcggguggacgggcaugaucgacggcugguacggguaccaccacgagaacagccagggcuccggguacgccgccgacaaggagagcacccagaaggccaucgacggcaucaccaacaaggugaacuccaucaucgacaagaugaacacccaguucgaggccgucgggcacgaguucagcaaccucgagcggcgcaucgacaaccugaacaagcgcauggaggacggcuuccuggacguguggacguacaacgcggagcuccuggugcugcucgagaacgagcggacccuggaccugcacgacgccaacgucaagaaccuccacgagaaggugcgcucccagcugcgggacaacgccaacgaccugggcaacgggugcuucgaguucuggcacaagugcgacaacgagugcauggagagcgucaagaacggcaccuacgacuaccccaaguaccagaaggagucccgccucaaccggcagaagaucgagagcgugaagcuggagaacuucgacguguaccagauccuggccaucuacuccaccgucagcuccagccucgugcugguggggcugauccucgccaugggccuguggaugugcuccaacggcagcaugcacugccgcaucugcaucuga

SEQ ID NO: 72120 - RNA, 1701 nt, Artificial Sequence
  derived and/or modified sequence opt1 from hemagglutinin__InfluenzaA__AHJ57885
augaucgccuucaucgugauggccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcagcggggagcggguggagcgcuucgagauguuccccaaguccaccugggccggcgucgacaccgacagcgggguguccagcgcgugcccgcucggcaacgggcccuccuucuaccggaaccugcuguggaucaucaagcgcaagagcuccgccuaccccgugauccggggcaccuucaacaacacgggcgacaagagcauccucuacuucuggggcguccaccacccgcccgugaccaccgagcaggaggcccuguacggguccgggaaccgcuacgugcggaugggcaccgagagcaugaacuucgcccgcaaccccgagaucgccgcgcggcccgccgucaacggccagcgcgggcggaucgacuacuucugguccauccugaagcccggcgagacgcucaacaucgagagcaacgggaaccugaucgccccgugguacgccuaccgcuucgugaacaaggacuccaagggcgccaucuuccggagcaaccugcccaucgaggacugcgacgcgagcugccagaccaccgagggggugauccgcaccaacaagacguuccagaacgucagcccccucuggaucggcgagugccccaaguacgugaaguccaagucccugcggcuggccaccggccuccgcaacgugccgcagaucgagacccgggggcuguucggcgccaucgccggguucaucgagggcggguggaccggcaugaucgacggcugguacggguaccaccacgagaacagccagggcuccggguacgccgcggaccgcgagagcacgcagaaggccaucgacggcaucaccaacaaggucaacuccaucaucgacaagaugaacacccaguucgaggccguggggcacgaguucagcaaccuggagcgccggaucgacaaccucgacaagcgcauggaggacggcuuccuggacguguggaccuacaacgccgagcugcucguccugcuggagaacgagcggacgcucgaccugcacgacgccaacgugaagaaccugcacgagaaggugcgcucccagcuccgggacaacgcgaacgaccugggcaacgggugcuucgaguucuggcacaagugcgacaacgagugcauggagagcgucaagaacggcaccuacgacuaccccaaguaccaggccgagucccgccugaaccggcagaagaucgagagcgugaagcucgagaacuucgacgucuaccagauccuggccaucuacuccaccgugagcuccagccuggugcucgucgggcugaucauggccaugggccuguggaugugcuccaacggcagcaugcagugccgcaucugcaucuga

SEQ ID NO: 72121 - RNA, 1701 nt, Artificial Sequence
  derived and/or modified sequence opt1 from hemagglutinin__InfluenzaA__AHJ57897
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcagcggggagcggguggagcgcuucgagauguuccccaaguccaccugggccggcgucgacaccgacagcgggguguccagcgcgugcccgcucggcaacgggcccuccuucuaccggaaccugcuguggaucaucaagcgcaagagcuccgccuaccccgugauccggggcaccuucaacaacacgggcgacaagagcauccucuacuucuggggcguccaccacccgcccgugaccaccgagcaggaggcccuguacggguccgggaaccgcuacgugcggaugggcaccgagagcaugaacuucgcccgcaaccccgagaucgccgcgcggcccgccgucaacggccagcgcgggcggaucgacuacuucugguccauccugaagcccggcgagacgcucaacaucgagagcaacgggaaccugaucgccccgugguacgccuaccgcuucgugaacaaggacuccaagggcgccaucuuccggagcaaccugcccaucgaggacugcgacgcgagcugccagaccaccgagggggugauccgcaccaacaagacguuccagaacgucagcccccucuggaucggcgagugccccaaguacgugaaguccaagucccugcggcuggccaccggccuccgcaacgugccgcagaucgagacccgggggcuguucggcgccaucgccggguucaucgagggcggguggaccggcaugaucgacggcugguacggguaccaccacgagaacagccagggcuccggguacgccgcggaccgcgagagcacgcagaaggccaucgacggcaucaccaacaaggucaacuccaucaucgacaagaugaacacccaguucgaggccguggggcacgaguucagcaaccuggagcgccggaucgacaaccucaacaagcgcauggaggacggcuuccuggacguguggaccuacaacgccgagcugcucguccugcuggagaacgagcggacgcucgaccugcacgacgccaacgugaagaaccugcacgagaaggugcgcucccagcuccgggacaacgcgaacgaccugggcaacgggugcuucgaguucuggcacaagugcgacaacgagugcauggagagcgucaagaacggcaccuacgacuaccccaaguaccaggccgagucccgccugaaccggcagaagaucgagagcgugaagcucgagaacuucgacgucuaccagauccuggccaucuacuccaccgugagcuccagccuggugcucgucgggcugaucauggccaugggccuguggaugugcuccaacggcagcaugcagugccgcaucugcaucuga

SEQ ID NO: 72122 - RNA, 1701 nt, Artificial Sequence
  derived and/or modified sequence opt1 from hemagglutinin__InfluenzaA__AHJ57908
augaucgccuucaucgugaucgccauccuggucgcgaccggcaagagcgacaagaucugcaucggguaccacgccaacaacuccaccacgaagguggacaccauccucgagaagaacgugaccgucacccacagcguggagcugcuggagaaccagaaggaggagcgcuucugcaagaucuccaacaaggcgccccucgaccugcgggacugcacgguggagggcuggauccuggggaacccgcgcugcggcauccucaucgccgaccagagcugguccuacaucgucgagcggcccaacgcccgcaacgggaucugcuaccccggcacccugaacgaggccgaggagcugaaggcccucaucggcagcggggagggcguggagcgguucgagauguuccccaaguccaccugggccgggguggacaccagcuccggcgucagcuccgccugcccgcuggggaacggccccagcuucuaccgcaaccugcucuggaucaucaagcugaaguccagcgaguaccccgugauccggggcacguucaacaacaccggggacaaguccgugcuguacuucuggggcguccaccacccgcccgugaccaccgagcaggacgcgcucuacgggagcggcaaccgcuacgugcggaugggcacggaguccaugaacuucgcccgcagccccgagaucgccgcccggcccgccgucaacgggcagcgcggccggaucgacuacuucugguccgugcugaagcccggggagacccugaacguggagagcaacggcaaccucaucgcgccgugguacgccuaccgcuucgucaacaaggacaacaagggggccaucuuccggagcaaccugcccaucgagaacugcgacgcgaccugccagaccacggagggcgugauccgcaccaacaagaccuuccagaacgugagcccccuguggaucggcgagugccccaaguacgucaaguccaagucccuccggcuggccaccgggcugcgcaacgugccgcagaucgagacgcggggccucuucggggccaucgccggcuucaucgagggcggguggaccggcaugaucgacgggugguacggcuaccaccacgagaacagccagggguccggcuacgccgccgaccgcgagagcacccagaaggccaucgacgggaucaccaacaaggugaacuccaucaucgacaagaugaacacgcaguucgaggcggccggccacgaguucagcaaccuggagcggcgcaucgacaaccugaacaagcgcauggaggacggcuuccucgacgucuggaccuacaacgccgagcugcuggugcuccuggagaacgagcggacccuggaccuccacgacgccaacgucaagaaccugcacgagaaggugaagucccagcugcgcgacaacgccaacgaccucgggaacggcugcuucgaguucuggcacaagugcgacaacgagugcauggagagcgugaagaacgggaccuacgacuaccccaaguaccagaaggagucccggcugaaccgccagcggaucgagagcgucaagcuggagaacuucgacguguaccagauccucgcgaucuacuccacggugagcuccagccuggucguggugggccugaucauggccaugggccucuggaugugcuccaacgggagcaugcagugcaugaucugcaucuga

SEQ ID NO: 72123 - RNA, 1701 nt, Artificial Sequence
  derived and/or modified sequence opt1 from hemagglutinin__InfluenzaA__AHJ57920
augaucgccaucaucaucaucgccauccugguggcgaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgaucgagggcuggauccuggggaacccguggugcggcauccuccuggccgaccagagcugguccuacaucguggagcgccccaacgcccggaacgggaucugcuaccccggcacccugaacgagguggaggagcucaaggcccugaucggcagcggggagcgcgucgagcgguucgagauguuccccaaguccaccugggccggcguggacaccaacagcgggguguccagcgccugcccgcugggcaacgggcccuccuucuaccgcaaccuccuguggaucaucaagaccaagagcuccgaguaccccgucaucaagggcaccuucaacaacaccggcgacaagagcgugcuguacuucuggggcgugcaccacccgcccucccggaacgagcagaacguccucuacgggagcggggaccgcuacgugcggaugggcaccgaguccaugaacuucgcccgcagccccgagaucgcggcccggcccgccgugaacggccagcgcgggcggaucgacuacuucugguccauccugaagcccggcgagacgcugaacgucgagagcaacgggaaccucaucgccccgugguacgccuaccgcuucgugaacaaggacagccggggcgcgaucuuccgcuccaaccugcccaucgagaacugcgacgccacgugccagaccgccgagggggugauccggaccaacaagacguuccagaacgucagcccccuguggaucggcgagugccccaaguacgugaaguccaagagccuccgccuggccaccggccugcggaacgugccgcagaucgagacccgcggccucuucggggccaucgcgggguucaucgagggcggguggaccggcaugaucgacggcugguacggguaccaccacgagaacucccagggcagcggguacgccgccgaccgggaguccacgcagaaggccaccgacggcaucaccaacaaggucaacagcaucaucgacaagaugaacacccaguucgaggccguggggcacgaguucuccaaccuggagcgccgcaucgacaaccugaacaagcggauggaggacggcuuccucgacguguggacguacaacgcggagcugcugguccuccuggagaacgagcgcacccuggaccuccacgacgccaacgugaagaaccugcacgagcgggucaagagccagcugcgcgacaacgccaacgaccucggcaacgggugcuucgaguucuggcacaagugcgacaacgagugcauggaguccgugaagaacgacaccuacgacuaccccaaguaccagaaggagagccggcugaaccgccagaagaucgaguccgugcggcuggagaacuucgacgucuaccagauccucgccaucuacagcaccguguccagcucccuggugcuggucggccucaucauggccauggggcuguggaugugcagcaacggcuccaugcagugccgcaucugcaucuga

SEQ ID NO: 72124 - RNA, 1701 nt, Artificial Sequence
  derived and/or modified sequence opt1 from hemagglutinin__InfluenzaA__AHJ57932
augaucgcccugaucaucaucaccauccucgugaccacgggcaagagcgacaagaucugcaucggguaccacgccaacaacuccaccaccaaggucgacaccauccuggagaagaacgugacggugacccacagcgucgagcugcucgagaaccagaaggaggagcgcuucugccggaucuccaacaaggcgccccuggaccugaaggagugcacccucgagggcuggauccuggggaacccgcagugcgaccugcuccugggcgaccagagcugguccuacaucguggagcgccccaacgcccggaacgggaucugcuaccccggcacccugaacgagguggaggagcuccgcgcccugaucggcagcggggagggcgucgagcgguucgagauguuccccaaguccacgugggccgggguggacaccaaccgcggcgugaccagcuccugcccguucgggagcggcuccagcuucuaccggaaccugcucuggaucgucaagcacaccacguccagcuaccccgugaucaagggcaccuuccgcaacaccggggacaaguccgugcuguacuucuggggcguccaccaccccuucgacaccaacgagcagaacgugcuguacgggagcggcaaccgguacgugcgcaugggcacggaguccaugaacuucgcccgggggcccgaggucgcggcccgcccgguggugaacggccagcgggggcgcaucgacuacuucuggagcauccucaagcccggcgagacccugaacaucgaguccaacgggaaccugaucgcccccugguacgccuaccgguucgucaacaaggacagcaagggcgcgaucuuccgcagcaaccuccccaucgaggacugcgacgcgaccugccagaccaucgagggcgugauccggacgaacaagaccuuccagaacguguccccgcuguggaucggggagugccccaaguacgucaagagcgagucccugcgccucgccaccggccugcggaacgugccccagaucgagacccgcgggcuguucggcgccaucgccggguucaucgagggcggcuggacggggaugaucgacggcugguacggguaccaccacgagaacagccagggcuccggguacgccgccgaccgggagagcacccagaaggccaucgacggcaucaccaccaaggugaacuccaucaucgacaagaugaacacgcaguucgaggccgucggccacgaguucagcaaccucgagcgccgcaucgacaaccugaacaagcggcuggaggacggguuccucgacguguggaccuacaacgccgagcugcugguccuccuggagaacgagcgcacccuggaccuccacgacgcgaacgugaagaaccugcacgagcgggugcgcucccagcugcgggacaacgccaacgaccucggcaacgggugcuucgaguucuggcacaagugcgacaacgagugcauggagagcguccgcaacggcaccuacaacuaccccaaguaccaggccgagucccggcugaacaagcagcgcaucgagagcgugaagcuggagaacuucgacguguaccagauccucgccaucuacuccacggucagcuccagccuggugcuggugggccucauccuggccauggggcuguggaugugcuccaacggcagcaugcagugccggaucugcaucuga

SEQ ID NO: 72125 - RNA, 1701 nt, Artificial Sequence
  derived and/or modified sequence opt1 from hemagglutinin__InfluenzaA__AHJ57943
augaucgccuucaucgugaucgccacccuggucgcgaccggcaagagcgacaagaucugcaucggguaccacgccaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcacccucaacgaggccgaggagcugaaggcccugaucggcagcggggagcgggucgagcgcuucgagauguuccccaaguccaccuggacgggcguggacaccgagagcgggguguccagcgccugcccgcucggcaacgggcccuccuucuaccggaaccugcuguggaucaucaagcucaagagcuccgaguaccccgucauccgcggcaccuucaacaacaccggcgacaagagcauccuguacuucuggggcgugcaccacccgcccgugacgaccgagcagaacgcccuguacggguccggggaccgguacguccgcaugggcaccgagagcaugaacuucgcgcggucccccgagaucgccgcccgccccgccgugaacggccagcgggggcgcaucgacuacuucuggagcauccucaagcccggcgagacccugaacguggaguccaacgggaaccugaucgccccgugguacgcguaccgguucgucaacaaggacagcaagggcgccaucuuccgcagcaaccuccccaucgagaacugcgacgccacgugccagaccaccgagggggugauccggaccaacaagacguuccagaacgugagcccccuguggaucggcgagugccccaaguacgucaaguccaagucccugcgccucgccaccggccugcggaacgugccgcagaucgagacccgcgggcuguucggcgccaucgcgggguucaucgagggcggguggaccggcaugaucgacggcugguacggguaccaccacgagaacagccagggcuccggguacgccgccgacaaggagagcacgcagaaggccaucgacggcaucaccaacaaggugaacuccaucaucgacaagaugaacacccaguucgagaccgucgggcacgaguucagcaaccucgagcggcgcaucgacaaccugaacaagcgcauggaggacggcuuccuggacguguggacguacaacgccgagcuccuggugcugcucgagaacgagcggacccuggaccugcacgacgcgaacgucaagaaccuccacgagaaggugcgcucccagcugcgggacaacgccaacgaccugggcaacgggugcuucgaguucuggcacaagugcaacaacgagugcauggagagcgucaagaacggcaccuacgacuaccccaaguaccagaaggagucccgccucaaccggcagaagaucgagagcgugaagcuggagaacuucgacguguaccagauccuggccaucuacuccaccgucagcuccagccucgugcugguggggcugauccucgccaugggccuguggaugugcuccaacggcagcaugcagugccgcaucugcaucuga

SEQ ID NO: 72126 - RNA, 1701 nt, Artificial Sequence
  derived and/or modified sequence opt1 from hemagglutinin__InfluenzaA__AHJ57954
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcagcggggagcggguggagcgcuucgagauguuccccaaguccaccugggccggcgucgacaccaacagcgggguguccagcgcgugcccgcucggcaacgggcccuccuucuaccggaaccugcuguggaucaucaagcagaaguccagcgccuaccccgugauccgcggcaccuucaacaacacgggcgacaagagcauccucuacuucuggggcguccaccacccgcccgugaccaccgagcaggaggcccuguacggguccgggaaccgguacgugcgcaugggcaccgagagcaugaacuucgcccggaaccccgagaucgccgcgcgccccgccgucaacggccagcgggggcgcaucgacuacuucugguccauccugaagcccggcgagacgcucaacguggagagcaacgggaaccugaucgccccgugguacgccuaccgguucgugaacaaggacuccaagggcgccaucuuccgcagcaaccugcccaucgagaacugcgacgcgaccugccagaccaccgagggggucauccggacgaacaagaccuuccagaacgugagcccccucuggaucggcgagugccccaaguacgugaaguccaagagccugcgccuggccaccggccuccggaacgucccgcagaucgagacccgcgggcuguucggcgccaucgccggguucaucgagggcggguggacgggcaugaucgacggcugguacggguaccaccacgagaacucccagggcagcggguacgccgcggaccgggaguccacccagaaggccaucgacggcaucaccaacaaggugaacagcaucaucgacaagaugaacacccaguucgaggccguggggcacgaguucuccaaccuggagcgccgcaucgacaaccucaacaagcggauggaggacggcuuccuggacgucuggacguacaacgccgagcugcucgugcugcuggagaacgagcgcacccucgaccugcacgacgccaacgugaagaaccugcacgagaagguccggagccagcuccgcgacaacgcgaacgaccugggcaacgggugcuucgaguucuggcacaagugcgacaacgagugcauggaguccgugaagaacggcaccuacgacuaccccaaguaccaggccgagagccggcugaaccgccagaagaucgaguccgucaagcucgagaacuucgacguguaccagauccuggccaucuacagcaccguguccagcucccugguccucguggggcugaucauggccaugggccuguggaugugcagcaacggcuccaugcagugccggaucugcaucuga

SEQ ID NO: 72127 - RNA, 1701 nt, Artificial Sequence
  derived and/or modified sequence opt1 from hemagglutinin__InfluenzaA__AHJ57965
augaucgccuucaucaucaucaccauccuggugaccacgggcaagagcgacaagaucugcaucggguaccacgccaacaacuccaccaccaaggucgacaccauccucgagaagaacgugacggugacccacagcgucgagcugcuggagaaccagaaggaggagcgcuucugcaagaucuccaacaaggcgccccucgaccugaaggagugcacccuggagggcuggauccucgggaacccgcagugcgaccugcugcucggcgaccagagcugguccuacaucguggagcggcccaacgcccgcaacgggaucugcuaccccggcacccugaacgagguggaggagcugaaggcccucaucggcagcggggagcgggucgagcgcuucgagauguuccccaaguccacgugggccggcguggacaccaacagcggggugaccuccagcugcuccuucggcagcggguccagcuucuaccggaaccugcuguggaucaucaagcacaccacguccagcuacccggucaucaagggcaccuuccgcaacaccggcgacaaguccgugcucuacuucuggggcgugcaccaccccaucgacaccacggagcagaacguccuguacgggagcgggaaccgguacgugcgcaugggcaccgaguccaugaacuucgcccggagccccgagaucgcggcccgccccguggucaacggccagcgggggcgcaucgacuacuucuggagcauccugaagccgggcgagacccucaacaucgaguccaacgggaaccugaucgcccccugguacgccuaccgguucgugaacaaggacagcaagggcgcgaucuuccgcuccaaccugcccaucgagaacugcgacgcgaccugccagacgaucgagggggugauccggaccaacaagaccuuccagaacgucagcccccucuggaucggcgagugcccgaaguacgugaaguccgagagccugcgccuggccaccggccuccggaacgugccccagaucgagacgcgcgggcuguucggcgccaucgccggguucaucgagggcggguggaccggcaugaucgacggcugguacggguaccaccacgagaacucccagggcagcggguacgccgccgaccgggaguccacccagcgcgccaucgacggcaucaccacgaaggucaacagcaucaucgacaagaugaacacccaguucgaggccguggggcacgaguucuccaaccuggagcggcgcaucgacaaccucaacaagcgcauggaggacggcuuccuggacguguggaccuacaacgccgagcugcucguccugcuggagaacgagcggacccucgaccugcacgacgcgaacgugaagaaccugcacgagcgcguccggagccagcuccgcgacaacgccaacgacggcgggaacggcugcuucgaguucuggcacaagugcgacaacgagugcauggaguccgugaagaacgggacguacgacuaccccaaguaccaggccgagagccgguccaaccgccagcggaucgagagcgugaagcuggagaacuucgacgucuaccagauccuggccaucuacuccaccgugagcuccagccucguggucguguggcugauccuggccaugggccucuggaugugcgcgaacggcagcaugcagugccgcaucugcaucuga

SEQ ID NO: 72128 - RNA, 1701 nt, Artificial Sequence
  derived and/or modified sequence opt1 from hemagglutinin__InfluenzaA__AHJ57977
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgaucgagggcuggauccuggggaacccgcgcugcggcauccuccuggccgaccagagcugguccuacaucguggagcggcccaacgcccgcaacgggaucugcuaccccggcacccugaacgagguggaggagcucaaggcccugaucggcagcggggagcgggucgagcgcuucgagauguuccccaaguccaccugggccggcguggacaccaacagcgggguguccagcgccugcccgcugggcaacgggcccuccuucuaccggaaccuccuguggaucaucaagcugaaguccuccgaguaccccgucauccgcggcacguucaacaacaccggcgacaagagcauccucuacuucuggggcgugcaccacccgcccgugaccaccgagcaggaggcgcuguacggguccggggaccgguacguccgcaugggcacggagagcaugaacuucgcccggucccccgagaucgccgcccgccccgccgugaacggccagcgggggcgcaucgacuacuucuggagcauccugaagcccggcgagacccucaacguggaguccaacgggaaccugaucgcgccgugguacgccuaccgguucgucaacaaggacagcaagggcgccaucuuccgcagcaaccugcccaucgagaacugcgacgcgaccugccagaccacggagggggugauccggaccaacaagaccuuccagaacgugagcccccucuggaucggcgagugccccaaguacgucaagagcaagucccugcgccuggccaccggccuccggaacgugccgcagaucgagacgcgcgggcuguucggcgccaucgccggguucaucgagggcggguggaccggcaugaucgacggcugguacggguaccaccacgagaacagccagggcuccggguacgccgccgacaaggagagcacccagaaggccaucgacggcaucaccaacaaggugaacuccaucaucgacaagaugaacacgcaguucgaggcggucgggcacgaguucagcaaccuggagcggcgcaucgacaaccucaacaagcgcauggaggacggcuuccuggacguguggaccuacaacgccgagcugcucgugcugcuggagaacgagcggacccucgaccugcacgacgccaacgucaagaaccugcacgagaaggugcgcucccagcuccgggacaacgccaacgaccugggcaacgggugcuucgaguucuggcacaagugcaacaacgagugcauggagagcgucaagaacggcaccuacgacuaccccaaguaccagaaggagucccgccugaaccggcagaagaucgagagcgugaagcucgagaacuucgacguguaccagauccuggccaucuacuccacggucagcuccagccuggugcucguggggcugauccuggcgaugggccucuggaugugcuccaacggcagcaugcagugccgcaucugcaucuga

SEQ ID NO: 72129 - RNA, 1701 nt, Artificial Sequence
  derived and/or modified sequence opt1 from hemagglutinin__InfluenzaA__AHJ57989
augaucgccuucaucgugaucgccauccuggucaccaccggcaagagcgacaagaucugcaucggguaccacgcgaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcacccucaacgaggucgaggagcugaaggcccugaucggcagcggggagcggguggagcgcuucgagauguuccccaaguccaccugggcccggguggacacggaccgcggcgucagcuccgccugcccgcucgggaacggccccagcuucuaccggaaccugcuguggaucgugaagcacaccaccuccgaguaccccgugaucaaggggaccuacacgaacaccggcgacaagagcguccucuacuucuggggcgugcaccacccgcccgacaccaccgagcagaacgugcuguacggguccggcaaccgcuacguccggauggggacggagagcaugaacuucgcccgcucccccgagaucgccgcgcggcccgccgugaacggccagcgcggccggaucgacuacuucuggagcauccugaagcccggggagacccucaacguggaguccaacggcaaccugaucgccccgugguacgccuaccgcuucgucaacaaggacagcaagggggccaucuuccgguccaaccugcccaucgagaacugcgacgcgaccugccagaccacggagggcgugauccgcaccaacaagaccuuccagaacgugagccccauguggaucggggagugccccaaguacgucaagagcaagucccuccggcuggccaccggccugcgcaacgugccgcagaucgagacgcggggccucuucggggccaucgccggcuucaucgagggcggguggaccgggaugaucgacggcugguacggcuaccaccacgagaacagccagggguccggcuacgccgcggaccgcgagagcacccagaaggccaucgacgggaucaccaacaaggugaacuccaucaucgacaagaugaacacgcaguucgaggccgucggccacgaguucagcaaccuggagcgccggaucgacaaccugaacaagcgcauggaggacggguuccucgacguguggaccuacaacgccgagcugcugguccuccuggagaacgagcggacccuggaccuccacgacuccaacgugaagaaccugcacgagcgcgucaagagccagcugcgggacaacgccaacgaccucggcaacggcugcuucgaguucuggcacaagugcgacaacgagugcauggaguccgugaagaacgggaccuacaacuaccccaaguaccaggcggagagccgccugaaccggcagaagaucgaguccgugaagcuggaggaguucggcguguaccagauccucgccaucuacagcacggucuccagcucccuggugcugguggggcucaucauggccaugggccuguggaugugcagcaacggcuccaugcagugccgcaucugcaucuga

SEQ ID NO: 72130 - RNA, 1701 nt, Artificial Sequence
  derived and/or modified sequence opt1 from hemagglutinin__InfluenzaA__AHJ58001
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcagcggggagcggguggagcgcuucgagauguuccccaaguccaccugggccggcgucgacaccgacagcgggguguccagcgcgugcccgcucggcaacgggcccuccuucuaccggaaccugcuguggaucaucaagcucaagagcuccgaguaccccgugauccgcggcaccuucaacaacacgggcgacaagagcauccuguacuucuggggcguccaccacccgcccgugaccaccgagcaggaggcccuguacggguccgggaaccgguacgugcgcaugggcaccgagagcaugaacuucgcccggucccccgagaucgccgcccgccccgcggucaacggccagcgggggcgcaucgacuacuucuggagcauccucaagcccggcgagacgcugaacguggaguccaacgggaaccugaucgccccgugguacgccuaccgguucgugaacaaggacagcaagggcgccaucuuccgcagcaaccuccccaucgagaacugcgacgcgaccugccagaccaccgagggggucauccggacgaacaagaccuuccagaacgugucccccauguggaucggcgagugccccaaguacgucaagagcaagucccugcgccuggccaccggccuccggaacgugccgcagaucgagacccgcgggcuguucggcgccaucgccggguucaucgagggcggguggacgggcaugaucgacggcugguacggguaccaccacgagaacagccagggcuccggguacgccgccgaccgggagagcacccagaaggcgaucgacggcaucaccaacaaggugaacuccaucaucgacaagaugaacacccaguucgaggccguggggcacgaguucagcaaccuggagcgccgcaucgacaaccucaacaagcggauggaggacggcuuccuggacgucuggacguacaacgccgagcugcucgugcugcuggagaacgagcgcacccucgaccugcacgacgccaacgugaagaaccugcacgagaagguccggucccagcuccgcgacaacgccaacgaccugggcaacgggugcuucgaguucuggcacaagugcgacaacgagugcauggagagcgugaagaacggcaccuacgacuaccccaaguaccagaccgagucccggcugaaccgccagaagaucgagagcgucaagcucgagaacuucgacguguaccagauccuggcgaucuacuccacggugagcuccagccugguccucguggggcugaucauggccaugggccuguggaugugcuccaacggcagcaugcagugccggaucugcaucuga

SEQ ID NO: 72131 - RNA, 1701 nt, Artificial Sequence
  derived and/or modified sequence opt1 from hemagglutinin__InfluenzaA__AHJ58013
augaucgccuucaucgugaucgccauccuggucaccaccggcaagagcgacaagaucugcaucggguaccacgcgaacaacuccacgaccaagguggacaccauccucgagaagaacgugaccgucacgcacagcguggagcugcuggagaaccagaaggaggagcgcuucugcaagaucuccagcaaggcgccccucgaccugcgggacugcucccuggagggcuggauccucgggaacccgcgcugcggcauccugcuggccgaccagagcugguccuacaucguggagcggcccaacgcccgcaacgggaucugcuaccccggcacccucaacgaggucgaggagcugaaggcccugaucggcagcggggagcggguggagcgcuucgagauguuccccaaguccaccugggccggcguggacaccaacagcggggucuccagcgccugcccgcucggcgaggggcccuccuucuaccggaaccugcuguggaucaucaagcgcacgaccagcgaguaccccgugaucaagggcaccuaccggaacaccggcgacaaguccgugcucuacuucuggggcguccaccacccgcccgacacgaccgagcagaacgugcuguacgggagcgggaaccgcuacgugcggaugggcaccgaguccaugaacuucgcccgcagccccgagaucgccgcgcggcccgccgucaacggccagcgcgggcggaucgacuacuucugguccauccugaagcccggcgagacccucgacguggagagcaacgggaaccugaucgccccgugguacgccuaccgcuucgugaacaaggagagcaagggcgccaucuuccgguccaaccugcccaucgagaacugcgacgcgacgugccagaccaccgagggggucauccgcaccaacaagacguuccagaacgugagcccccucuggaucggcgagugccccaaguacgugaaguccaagagccugcggcuggccaccggccuccgcaacgucccgcagaucgagacccgggggcuguucggcgccaucgccggguucaucgagggcggguggaccggcaugaucgacggcugguacggguaccaccacgagaacucccagggcagcggguacgccgcggacaaggaguccacgcagaaggccaucgacggcaucaccaacaaggugaacagcaucaucgacaagaugaacacccaguucgaggccguggggcacgaguucuccacccuggagcgccgcaucgacaaccucaacaagcggauggaggacggcuuccuggacgucuggacguacaacgccgagcugcucgugcugcuggagaacgagcgcacccucgaccugcacgacgccaacgucaagaaccugcacgagcgggugcgcagccagcuccgggacaacgcgaacgaccugggcaacgggugcuucgaguucuggcacaagugcgacaacgagugcauggaguccgugaagaacggcaccuacaacuaccccaaguaccaggccgagagccgccugaacaagcagaagaucgaguccgucaagcucgaggaguucgggguguaccagauccuggccaucuacagcaccguguccagcucccugguccucgugggccugaucauggccaugggccuguggaugugcagcaacggguccaugcagugccggaucugcaucuga

SEQ ID NO: 72132 - RNA, 1701 nt, Artificial Sequence
  derived and/or modified sequence opt1 from hemagglutinin__InfluenzaA__AHJ58025
augaucgccuucaucgugaucgccauccuggucaccaccggcgagagcgacaagaucugcaucggguaccacgcgaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcaccaucgagggcuggauccuggggaacccgcgcugcggcauccuccuggccgaccagagcugguccuacaucguggagcggcccaacgcccgcaacgggaucugcuaccccggcacccugaacgaggccgaggagcucaaggcccugaucggcagcggggagggcgucgagcgguucgagauguuccccaaguccaccugggccgggguggacacgaacagcggcguguccagcgccugcccgcuggggaacggccccuccuucuaccgcaaccuccuguggaucaucaagcugaaguccuccgaguaccccgucauccggggcaccuucaacaacaccggggacaagagcgugcucuacuucuggggcgugcaccacccgcccgucaccacggagcagaacgaccuguacggguccggcaaccgcuacgugcggaugggcaccgagagcaugaacuucgcccgcaaccccgagaucgcgcugcggcccgccgugaacgggcagcgcggccggaucgacuacuucugguccauccucaagcccggggagacccugaacgucgagagcaacggcaaccugaucgccccgugguacgccuaccgcuucgugaacaaggacuccaagggggccaucuuccggagcagccuccccaucgagaacugcgacgcgaccugccagacggccgagggcgugauccgcaccaacaagaccuuccagaacgucagcccccuguggaucggcgagugccccaaguacgucaagagcaagucccugcggcucgccaccgggcugcgcaacgugccgcagaucgagacgcggggccuguucggggccaucgccggcuucaucgagggcggguggaccggcaugguggacgggugguacggcuaccaccacgagaacagccagggguccggcuacgcggccgaccgcgagagcacccagaaggccaucgacgggaucaccaacaaggugaacuccaucaucgacaagaugaacacgcaguucgaggccguggaccacgaguucagcaaccucgagcggcgcaucgacaaccugaacaagcgcauggaggacggcuuccuggacgucuggaccuacaacgccgagcuccuggugcugcucgagaacgagcggacccuggaccugcacgacgcgaacgucaagaaccuccacgagaaggugaagucccagcugcgcgacaacgccaacgaccugggcaacgggugcuucgaguucuggcacaagugcgacaacgagugcauggagagcgugaagaacggcaccuacaacuaccccaaguaccagaaggagucccggcucaaccgccagaagaucgagagcgucaagcuggagaacuucgacguguaccagauccuggccaucuacuccacggugagcuccagccucguccugguggggcugaucauggccaugggccucuggaugugcuccaacggcagcaugcagugccggaucugcaucuga

SEQ ID NO: 72133 - RNA, 1701 nt, Artificial Sequence
  derived and/or modified sequence opt1 from hemagglutinin__InfluenzaA__AHJ58037
augaucgccuucaucaucaucaccauccuggugaccacgggcgagagcgacaagaucugcaucggguaccacgccaacaacuccaccaccaaggucgacaccauccucgagaagaacgugacggugacccacagcgucgagcugcuggagaaccagaaggaggagcgcuucugcaagaucuccaacaaggcgccccucgaccugaaggagugcacccuggagggcuggauccucgggaacccgcagugcgaccugcugcucggcgaccagagcugguccuacaucguggagcggcccaacgcccgcaacgggaucugcuaccccggcacccugaacgagguggaggagcugaaggcccucaucggcagcggggagcgggucgagcgcuucgagauguuccccaaguccacgugggccggcguggacaccaacagcggggugacccgguccugcccguucggcagcggguccagcuucuaccgcaaccugcuguggaucaucaagcacaccacguccagcuaccccgucaucaagggcaccuuccggaacaccggcgacaaguccgugcucuacuucuggggcgugcaccaccccaucgacaccacggagcagaacguccuguacgggagcgggaaccgcuacgugcggaugggcaccgaguccaugaacuucgcccgcagccccgagaucgcggcccggccgguggucaacggccagcgcgggcggaucgacuacuucugguccauccugaagcccggcgagacccucaacaucgagagcaacgggaaccugaucgcccccugguacgccuaccgcuucgugaacaaggacagcaagggcgcgaucuuccgguccaaccugcccaucgagaacugcgacgcgaccugccagacgaucgagggggugauccgcaccaacaagaccuuccagaacgucagcccgcucuggaucggcgagugccccaaguacgugaaguccgagagccugcggcuggccaccggccuccgcaacgugccccagaucgagacgcgggggcuguucggcgccaucgccggguucaucgagggcggguggaccggcaugaucgacggcugguacggguaccaccacgagaacucccagggcagcggguacgccgccgaccgcgaguccacccagcgggccaucgacggcaucaccacgaaggucaacagcaucaucgacaagaugaacacccaguucgaggccguggggcacgaguucuccaaccuggagcgccgcaucgacaaccucaacaagcggauggaggacggcuuccuggacguguggaccuacaacgccgagcugcucguccugcuggagaacgagcgcacccucgaccugcacgacgcgaacgugaagaaccugcacgagcgggucaagagccagcuccgcgacaacgccaacgaccugggcaacgggugcuucgaguucuggcacaagugcgacaacgagugcauggaguccgugaagaacggcacguacgacuaccccaaguaccaggccgagagccggcugaacaagcagcgcaucgaguccgugaagcucgagaacuucgacgucuaccagauccuggccaucuacagcaccguguccagcucccuggugcucgucgggcugaucauggccaucggccuguggaugugcagcaacggcuccaugcagugccggaucugcaucuga

SEQ ID NO: 72134 - RNA, 1701 nt, Artificial Sequence
  derived and/or modified sequence opt1 from hemagglutinin__InfluenzaA__AHJ58049
augaucgccuucaucgugaucgccauccuggcggccaccggcaagagcgacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcagcggggagcggguggagcgcuucgagauguuccccaaguccaccugggccggcgucgacaccgacagcgggguguccagcgcgugcccgcucggcaacgggcccuccuucuaccggaaccugcuguggaucaucaagcucaagagcuccgaguaccccgugauccgcggcaccuucaacaacacgggcgacaagagcauccuguacuucuggggcguccaccacccgcccgugaccaccgagcaggaggcccuguacggguccgggaaccgguacgugcgcaugggcaccgagagcaugaacuucgcccggacgcccgagaucgccgcccgccccgcggucaacggccagcgggggcgcaucgacuacuucugguccauccucaagcccggcgagacccugaacguggagagcaacgggaaccugaucgccccgugguacgccuaccgguucgugaacaaggacuccaagggcgccaucuuccgcagcaaccuccccaucgagaacugcgacgcgaccugccagaccacggagggggucauccggaccaacaagaccuuccagaacgugagcccccuguggaucggcgagugccccaaguacgugaaguccaagagccugcgccucgccaccggccugcggaacgucccgcagaucgagacgcgcgggcuguucggcgccaucgccggguucaucgagggcggguggaccggcaugaucgacggcugguacggguaccaccacgagaacucccagggcagcggguacgccgccgaccgggaguccacccagaaggcgaucgacggcaucaccaacaaggugaacagcaucaucgacaagaugaacacgcaguucgaggccguggggcacgaguucuccaaccucgagcgccgcaucgacaaccugaacaagcggauggaggacggcuuccuggacgucuggaccuacaacgccgagcuccuggugcugcucgagaacgagcgcacccuggaccugcacgacgccaacgugaagaaccuccacgagaagguccggagccagcugcgcgacaacgccaacgaccugggcaacgggugcuucgaguucuggcacaagugcgacaacgagugcauggaguccgugaagaacggcaccuacgacuaccccaaguaccaggcggagagccggcucaaccgccagaagaucgaguccgucaagcuggagaacuucgacguguaccagauccuggccaucuacagcacgguguccagcucccucguccugguggggcugaucauggccaugggccucuggaugugcagcaacggcuccaugcagugccggaucugcaucuga

SEQ ID NO: 72135 - RNA, 1701 nt, Artificial Sequence
  derived and/or modified sequence opt1 from hemagglutinin__InfluenzaA__AHJ58061
augaucgccuucaucgugaucgccacccuggucgcgaccggcaagagcgacaagaucugcaucggguaccacgccaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcacccucaacgaggccgaggagcugaaggcccugaucggcagcggggagcgggucgagcgcuucgagauguuccccaaguccaccuggacgggcguggacaccgagagcgggguguccagcgccugcccgcucggcaacgggcccuccuucuaccggaaccugcuguggaucaucaagcucaagagcuccgaguaccccgucauccgcggcaccuucaacaacaccggcgacaagagcauccuguacuucuggggcgugcaccacccgcccgugacgaccgagcagaacgcccuguacggguccggggaccgguacguccgcaugggcaccgagagcaugaacuucgcgcggucccccgagaucgccgcccgccccgccgugaacggccagcgggggcgcaucgacuacuucuggagcauccucaagcccggcgagacccugaacguggaguccaacgggaaccugaucgccccgugguacgcguaccgguucgucaacaaggacagcaagggcgccaucuuccgcagcaaccuccccaucgagaacugcgacgccacgugccagaccaccgagggggugauccggaccaacaagacguuccagaacgugagcccccuguggaucggcgagugccccaaguacgucaaguccaagucccugcgccucgccaccggccugcggaacgugccgcagaucgagacccgcgggcuguucggcgccaucgcgggguucaucgagggcggguggaccggcaugaucgacggcugguacggguaccaccacgagaacagccagggcuccggguacgccgccgacaaggagagcacgcagaaggccaucgacggcaucaccaacaaggugaacuccaucaucgacaagaugaacacccaguucgaggccgucgggcacgaguucagcaaccucgagcggcgcaucgacaaccugaacaagcgcauggaggacggcuuccuggacguguggaccuacaacgcggagcuccuggugcugcucgagaacgagcggacgcuggaccugcacgacgccaacgucaagaaccuccacgagaaggugcgcucccagcugcgggacaacgccaacgaccugggcaacgggugcuucgaguucuggcacaagugcaacaacgagugcauggagagcgucaagaacggcaccuacgacuaccccaaguaccagaaggagucccgccucaaccggcagaagaucgagagcgugaagcuggagaacuucgacguguaccagauccuggccaucuacuccaccgucagcuccagccucgugcugguggggcugauccucgccaugggccuguggaugugcuccaacggcagcaugcagugccgcaucugcaucuga

SEQ ID NO: 72136 - RNA, 1701 nt, Artificial Sequence
  derived and/or modified sequence opt1 from hemagglutinin__InfluenzaA__AHJ58084
augaucgccuucaucgugaucgccacccuggucgcgaccggcaagagcgacaagaucugcaucggguaccacgccaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcacccucaacgaggccgaggagcugaaggcccugaucggcagcggggagcgggucgagcgcuucgagauguuccccaaguccaccuggacgggcgugaacaccgagagcgggguguccagcgccugcccgcucggcaacgggcccuccuucuaccggaaccugcuguggaucaucaagcucaagagcuccgaguaccccgucauccgcggcaccuucaacaacaccggcgacaagagcauccuguacuucuggggcgugcaccacccgcccgugacgaccgagcagaacgcccuguacggguccggggaccgguacguccgcaugggcaccgagagcaugaacuucgcgcggucccccgagaucgccgcccgccccgccgugaacggccagcgggggcgcaucgacuacuucuggagcauccucaagcccggcgagacccugaacguggaguccaacgggaaccugaucgccccgugguacgcguaccgguucgucaacaaggacagcaagggcgccaucuuccgcagcaaccuccccaucgagaacugcgacgccacgugccagaccaccgagggggugauccggaccaacaagacguuccagaacgugagcccccuguggaucggcgagugccccaaguacgucaaguccaagucccugcgccucgccaccggccugcggaacgugccgcagaucgagacccgcgggcuguucggcgccaucgcgggguucaucgagggcggguggaccggcaugaucgacggcugguacggguaccaccacgagaacagccagggcuccggguacgccgccgacaaggagagcacgcagaaggccaucgacggcaucaccaacaaggugaacuccaucaucgacaagaugaacacccaguucgaggccgucgggcacgaguucagcaaccucgagcggcgcaucgacaaccugaacaagcgcauggaggacggcuuccuggacguguggaccuacaacgcggagcuccuggugcugcucgagaacgagcggacgcuggaccugcacgacgccaacgucaagaaccuccacgagaaggugcgcucccagcugcgggacaacgccaacgaccugggcaacgggugcuucgaguucuggcacaagugcaacaacgagugcauggagagcgucaagaacggcaccuacgacuaccccaaguaccagaaggagucccgccucaaccggcagaagaucgagagcgugaagcuggagaacuucgacguguaccagauccuggccaucuacuccaccgucagcuccagccucgugcugguggggcugauccucgccaugggccuguggaugugcuccaacggcagcaugcagugccgcaucugcaucuga

SEQ ID NO: 72137 - RNA, 1701 nt, Artificial Sequence; identical to SEQ ID NO: 67863
  derived and/or modified sequence opt1 from hemagglutinin__InfluenzaA__AHL80708

SEQ ID NO: 72138 - RNA, 1701 nt, Artificial Sequence
  derived and/or modified sequence opt1 from hemagglutinin__InfluenzaA__AHL80718
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaucagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgagcgugcacgacugcaacacgaccugccagacccccaagggcgccaucaacaccucccugccguuccagaacauccaccccaucaccaucgggaagugccccaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 72139 - RNA, 1710 nt, Artificial Sequence
  derived and/or modified sequence opt1 from hemagglutinin__InfluenzaA__AHL80729
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucggggagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugaccagccugcccuuccagaacgugcaccccaucaccaucgggaagugccccaaguacgucaaguccaccaagcuccggcuggcgacgggccugcgcaacgugccgagcauccagucccggggccucuucggggccaucgccggguucaucgagggcggcuggaccgggaugguggacggcugguacggguaccaccaccagaacgagcagggcagcggguacgccgccgaccugaaguccacccagaacgcgaucgacgagaucaccaacaaggucaacagcgugaucgagaagaugaacacgcaguucaccgccgucggcaaggaguucaaccaccuggagaagcgcaucgagaaccucaacaagaagguggacgacggcuuccuggacaucuggaccuacaacgccgagcugcucgugcugcuggagaacgagcggacccucgacuaccacgacuccaacgucaagaaccuguacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgucaagcuggaguccacccgcaucuaccagauccuggcgaucuacagcaccguggccagcucccucgugcuggucgugagccugggggccaucuccuucuggaugugcagcaacggcucccuccagugccggaucugcaucuga

SEQ ID NO: 72140 - RNA, 1701 nt, Artificial Sequence
  derived and/or modified sequence opt1 from hemagglutinin__InfluenzaA__AHL80740
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccagcugguccuacaucguggagaccagcuccagcgacaacggcacgugcuaccccggcgacuucaucaacuacgaggagcugcgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccuguggggcgugcaccaccccagcaccagcgccgaccagcagucccuguaccagaacgccgacgccuacguguucgucgggacgagccgguacuccaagaaguucaagcccgagaucgccauccgcccgaaggugcgggaccaggagggccgcaugaacuacuacuggacccucguggagcccggggacaagaucaccuucgaggcgaccggcaaccuggucgugccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgucaaguccaccaagcuccggcuggcgaccggccugcgcaacgugccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggucaacagcgugaucgagaagaugaacacccaguucacggccgucggcaaggaguucaaccaccuggagaagcgcaucgagaaccucaacaagaagguggacgacggcuuccuggacaucuggaccuacaacgccgagcugcucgugcugcuggagaacgagcggacccucgacuaccacgacuccaacgucaagaaccuguacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggagaagaucgacggcgucaagcuggaguccacccgcaucuaccagauccuggcgaucuacagcaccguggccuccagccucgugcuggucgugagccugggggccaucuccuucuggaugugcagcaacggcucccuccagugccggaucugcaucuga

SEQ ID NO: 72141 - RNA, 1701 nt, Artificial Sequence
  derived and/or modified sequence opt1 from hemagglutinin__InfluenzaA__AHL80751
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggagauccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagguggggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 72142 - RNA, 1701 nt, Artificial Sequence
  derived and/or modified sequence opt1 from hemagglutinin__InfluenzaA__AHL80762
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggauccugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaaggacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 72143 - RNA, 1701 nt, Artificial Sequence
  derived and/or modified sequence opt1 from hemagglutinin__InfluenzaA__AHL80784
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaaggggaucaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 72144 - RNA, 1701 nt, Artificial Sequence; identical to SEQ ID NO: 64841
  derived and/or modified sequence opt1 from hemagglutinin__InfluenzaA__AHL80795

SEQ ID NO: 72145 - RNA, 1701 nt, Artificial Sequence
  derived and/or modified sequence opt1 from hemagglutinin__InfluenzaA__AHL80817
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaacugcaacaucgccggcuggauccuggggaacccggagugcgagagccuguccaccgccagcuccuggagcuacaucguggaggccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 72146 - RNA, 1701 nt, Artificial Sequence; identical to SEQ ID NO: 72145
  derived and/or modified sequence opt1 from hemagglutinin__InfluenzaA__AHL80828

SEQ ID NO: 72147 - RNA, 1701 nt, Artificial Sequence
  derived and/or modified sequence opt1 from hemagglutinin__InfluenzaA__AHL80839
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaaggggaucaccgccgccugcccgcacgccggcgcgaaguccuucuacaagaaccugaucuggcucgucaagaaggggaacagcuaccccaagcugucccggagcuacaucaacgacaagggcaaggaggugcuggugcucugggggauccaccaccccagcaccuccgccgaccagcagagccuguaccagaacgccgacgccuacgucuucgugggcacgucccgcuacagcaagaaguucaagcccgagaucgccauccggccgaaggugcgcgaccaggagggccggaugaacuacuacuggacccuggucgagcccggggacaagaucaccuucgaggcgaccggcaaccucguggugccccgcuacgccuucgccauggagcggaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 72148 - RNA, 1701 nt, Artificial Sequence
  derived and/or modified sequence opt1 from hemagglutinin__InfluenzaA__AHL80861
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucggcaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 72149 - RNA, 1701 nt, Artificial Sequence
  derived and/or modified sequence opt1 from hemagglutinin__InfluenzaA__AHL80872
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaacgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 72150 - RNA, 1701 nt, Artificial Sequence; identical to SEQ ID NO: 64841
  derived and/or modified sequence opt1 from hemagglutinin__InfluenzaA__AHL80883

SEQ ID NO: 72151 - RNA, 1701 nt, Artificial Sequence; identical to SEQ ID NO: 64841
  derived and/or modified sequence opt1 from hemagglutinin__InfluenzaA__AHL80894

SEQ ID NO: 72152 - RNA, 1701 nt, Artificial Sequence; identical to SEQ ID NO: 64841
  derived and/or modified sequence opt1 from hemagglutinin__InfluenzaA__AHL80905

SEQ ID NO: 72153 - RNA, 1701 nt, Artificial Sequence; identical to SEQ ID NO: 67462
  derived and/or modified sequence opt1 from hemagglutinin__InfluenzaA__AHL80916

SEQ ID NO: 72154 - RNA, 1701 nt, Artificial Sequence; identical to SEQ ID NO: 67863
  derived and/or modified sequence opt1 from hemagglutinin__InfluenzaA__AHL80927

SEQ ID NO: 72155 - RNA, 1701 nt, Artificial Sequence; identical to SEQ ID NO: 67863
  derived and/or modified sequence opt1 from hemagglutinin__InfluenzaA__AHL80946

SEQ ID NO: 72156 - RNA, 1701 nt, Artificial Sequence
  derived and/or modified sequence opt1 from hemagglutinin__InfluenzaA__AHL80958
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaucagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgagcgugcacgacugcaacacgaccugccagacccccaagggcgccaucaacaccucccugccguuccagaacauccaccccaucaccaucgggaagugccccaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 72157 - RNA, 1701 nt, Artificial Sequence
  derived and/or modified sequence opt1 from hemagglutinin__InfluenzaA__AHL81001
augaagaccaucaucgcccugagcuacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagagcuccagcaccggggagaucugcaacagcccccaccagauccucgacggcgagaacugcacccugaucgacgcccugcucggggacccccagugcgacggcuuccagaacaagaagugggaccuguucgucgagcgcagcaaggcccacuccaacugcuaccccuacgacgugccggacuacgcgagccugcggucccucguggccagcuccggcacgcuggaguucaacaacgagagcuucaacuggaccggggucacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccgccgggcggaucaccgucagcacgaagcgcucccagcaggccgugaucccgaacaucggcagccggccccgcgugcggaacauccccagccgcgucuccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgcgggguucaucgagaacggcugggagggcaugguggacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgcggagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgcgaucuccugcuuccuccugugcguggcccugcucggcuucaucaugugggccugccagaaggggaacauccggugcaacaucugcaucuga

SEQ ID NO: 72158 - RNA, 1701 nt, Artificial Sequence; identical to SEQ ID NO: 67863
  derived and/or modified sequence opt1 from hemagglutinin__InfluenzaA__AHL81013

SEQ ID NO: 72159 - RNA, 1701 nt, Artificial Sequence; identical to SEQ ID NO: 67863
  derived and/or modified sequence opt1 from hemagglutinin__InfluenzaA__AHL81025

SEQ ID NO: 72160 - RNA, 1701 nt, Artificial Sequence; identical to SEQ ID NO: 67863
  derived and/or modified sequence opt1 from hemagglutinin__InfluenzaA__AHL81037

SEQ ID NO: 72161 - RNA, 1701 nt, Artificial Sequence; identical to SEQ ID NO: 67863
  derived and/or modified sequence opt1 from hemagglutinin__InfluenzaA__AHL81049

SEQ ID NO: 72162 - RNA, 1701 nt, Artificial Sequence; identical to SEQ ID NO: 72156
  derived and/or modified sequence opt1 from hemagglutinin__InfluenzaA__AHL81061

SEQ ID NO: 72163 - RNA, 1701 nt, Artificial Sequence; identical to SEQ ID NO: 72156
  derived and/or modified sequence opt1 from hemagglutinin__InfluenzaA__AHL81072

SEQ ID NO: 72164 - RNA, 1701 nt, Artificial Sequence; identical to SEQ ID NO: 69369
  derived and/or modified sequence opt1 from hemagglutinin__InfluenzaA__AHL81083

SEQ ID NO: 72165 - RNA, 1701 nt, Artificial Sequence; identical to SEQ ID NO: 67863
  derived and/or modified sequence opt1 from hemagglutinin__InfluenzaA__AHL81095

SEQ ID NO: 72166 - RNA, 1701 nt, Artificial Sequence
  derived and/or modified sequence opt1 from hemagglutinin__InfluenzaA__AHL81118
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccaacagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucucccugggggccaucagcuucuggaugugcagcaacggcucccugcagugccggaucugcaucuga

SEQ ID NO: 72167 - RNA, 1701 nt, Artificial Sequence; identical to SEQ ID NO: 67863
  derived and/or modified sequence opt1 from hemagglutinin__InfluenzaA__AHL81129

SEQ ID NO: 72168 - RNA, 1701 nt, Artificial Sequence; identical to SEQ ID NO: 67863
  derived and/or modified sequence opt1 from hemagglutinin__InfluenzaA__AHL81141

SEQ ID NO: 72169 - RNA, 1701 nt, Artificial Sequence; identical to SEQ ID NO: 67863
  derived and/or modified sequence opt1 from hemagglutinin__InfluenzaA__AHL81153

SEQ ID NO: 72170 - RNA, 1701 nt, Artificial Sequence
  derived and/or modified sequence opt1 from hemagglutinin__InfluenzaA__AHL81165
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcgcugcucggcuucaucaugugggccugccagaaggggaacauccgcugcaacaucugcaucuga

SEQ ID NO: 72171 - RNA, 1701 nt, Artificial Sequence; identical to SEQ ID NO: 72170
  derived and/or modified sequence opt1 from hemagglutinin__InfluenzaA__AHL81177

SEQ ID NO: 72172 - RNA, 1701 nt, Artificial Sequence; identical to SEQ ID NO: 72157
  derived and/or modified sequence opt1 from hemagglutinin__InfluenzaA__AHL81189

SEQ ID NO: 72173 - RNA, 1701 nt, Artificial Sequence
  derived and/or modified sequence opt1 from hemagglutinin__InfluenzaA__AHL81212
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaagaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 72174 - RNA, 1701 nt, Artificial Sequence
  derived and/or modified sequence opt1 from hemagglutinin__InfluenzaA__AHL81224
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaccgccggcuccggcaucaucaucagcgacacccccgugcacgacugcaacacgaccugccagaccccgaagggggccaucaacaccucccugcccuuccagaacauccaccccaucacgaucggcaagugccccaaguacgucaagagcaccaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 72175 - RNA, 1701 nt, Artificial Sequence; identical to SEQ ID NO: 67863
  derived and/or modified sequence opt1 from hemagglutinin__InfluenzaA__AHL81235

SEQ ID NO: 72176 - RNA, 1701 nt, Artificial Sequence; identical to SEQ ID NO: 67863
  derived and/or modified sequence opt1 from hemagglutinin__InfluenzaA__AHL81247

SEQ ID NO: 72177 - RNA, 1701 nt, Artificial Sequence; identical to SEQ ID NO: 67863
  derived and/or modified sequence opt1 from hemagglutinin__InfluenzaA__AHL81259

SEQ ID NO: 72178 - RNA, 1701 nt, Artificial Sequence; identical to SEQ ID NO: 67863
  derived and/or modified sequence opt1 from hemagglutinin__InfluenzaA__AHL81271

SEQ ID NO: 72179 - RNA, 1701 nt, Artificial Sequence; identical to SEQ ID NO: 67863
  derived and/or modified sequence opt1 from hemagglutinin__InfluenzaA__AHL81283

SEQ ID NO: 72180 - RNA, 1701 nt, Artificial Sequence; identical to SEQ ID NO: 67863
  derived and/or modified sequence opt1 from hemagglutinin__InfluenzaA__AHL81295

SEQ ID NO: 72181 - RNA, 1701 nt, Artificial Sequence; identical to SEQ ID NO: 72156
  derived and/or modified sequence opt1 from hemagglutinin__InfluenzaA__AHL81307

SEQ ID NO: 72182 - RNA, 1701 nt, Artificial Sequence; identical to SEQ ID NO: 67875
  derived and/or modified sequence opt1 from hemagglutinin__InfluenzaA__AHL81329

SEQ ID NO: 72183 - RNA, 1701 nt, Artificial Sequence
  derived and/or modified sequence opt1 from hemagglutinin__InfluenzaA__AHL81340
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccaggacggcaccuccagcgccugcauccgcggguccaagaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgccaucccgaacaucggcagccgcccccgggugcgcaacauccccucccggaucagcaucuacuggaccaucgucaagcccggggacauccugcucaucaacuccaccggcaaccugaucgccccgcgcggguacuucaagauccggagcggcaaguccagcaucaugcgcuccgacgcgcccaucggcaagugcaacagcgagugcaucacccccaacggguccauccccaacgacaagccguuccagaacgugaaccggaucacguacggcgccugcccccgcuacgugaagcagaacacccugaagcucgccaccgggaugcggaacguccccgagaagcagacccgcggcaucuucggggccaucgccggcuucaucgagaacggcugggaggggaugguggacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcgcuggagaaccagcacaccaucgaccucacggacagcgagaugaacaagcuguucgagaagaccaagaagcagcugcgggagaacgccgaggacaugggcaacgggugcuucaagaucuaccacaagugcgacaacgccugcaucggcuccauccgcaacgggaccuacaaccacgacguguaccgcgacgaggcccucaacaagcgguuccagaucaagggcaucgagcugaaguccggcuacaaggacuggauccuguggaucuccuucgccaucagcugcuuccuccugugcgucgcgcugcucggguucaucaugugggccugccagaagggcaacauccgcugcaacaucugcaucuga

SEQ ID NO: 72184 - RNA, 1701 nt, Artificial Sequence; identical to SEQ ID NO: 67863
  derived and/or modified sequence opt1 from hemagglutinin__InfluenzaA__AHL81352

SEQ ID NO: 72185 - RNA, 1701 nt, Artificial Sequence
  derived and/or modified sequence opt1 from hemagglutinin__InfluenzaA__AHL81364
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcgccugcuaccccggcgacuucaucaacuacgaggagcuccgggagcagcugagcuccgugagcuccuucgagcgcuucgagaucuuccccaagacgaacagcuggcccaaccacgacuccaacaagggggucaccgccgccugcccgcacgcgggcgccaagagcuucuacaagaaccugaucuggcucgugaagaaggggaacuccuaccccaagcugagcaaguccuacaucaacgacaagggcaaggaggugcugguccucugggggauccaccaccccagcaccaccgccgaccagcagagccuguaccagaacgccgacgccuacguguucgugggcacgucccgguacagcaagaaguucaagcccgagaucgcgauccgcccgaagguccgggaccaggagggccgcaugaacuacuacuggacccugguggagcccggggacaagaucaccuucgaggccaccggcaaccucguggucccccgguacgccuucgccauggagcgcaacgccggguccggcaucaucaucagcgacacgcccgugcacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcucgaguccacccgcaucuaccagauccuggccaucuacagcaccgucgccuccagccuggugcucguggucucccugggggccaucagcuucuggaugugcagcaacggcucccugcagugccggaucugcaucuga

SEQ ID NO: 72186 - RNA, 1701 nt, Artificial Sequence
  derived and/or modified sequence opt1 from hemagglutinin__InfluenzaA__AHL81386
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccaacagcuggcccaaccacgacuccaacaagggggucaccgccgccugcccgcacgccggcgucaagagcuucuacaagaaccugaucuggcucgugaagaaggggaacuccuaccccaagcugagcaaguccuacaucaacgacaagggcaaggaggugcuggugcucugggggauccaccaccccagcaccacggcggaccagcagagccuguaccagaacgccgacgccuacguguucgucggcaccucccgguacagcaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggucaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacagcaccguggcguccagccuggugcucgucgugucccugggggccaucagcuucuggaugugcagcaacggcucccugcagugccggaucugcaucuga

SEQ ID NO: 72187 - RNA, 1701 nt, Artificial Sequence; identical to SEQ ID NO: 67863
  derived and/or modified sequence opt1 from hemagglutinin__InfluenzaA__AHL81397

SEQ ID NO: 72188 - RNA, 1701 nt, Artificial Sequence; identical to SEQ ID NO: 72173
  derived and/or modified sequence opt1 from hemagglutinin__InfluenzaA__AHL81409

SEQ ID NO: 72189 - RNA, 1701 nt, Artificial Sequence; identical to SEQ ID NO: 72143
  derived and/or modified sequence opt1 from hemagglutinin__InfluenzaA__AHL81419

SEQ ID NO: 72190 - RNA, 1701 nt, Artificial Sequence; identical to SEQ ID NO: 64841
  derived and/or modified sequence opt1 from hemagglutinin__InfluenzaA__AHL81430

SEQ ID NO: 72191 - RNA, 1701 nt, Artificial Sequence; identical to SEQ ID NO: 61638
  derived and/or modified sequence opt1 from hemagglutinin__InfluenzaA__AHL88951

SEQ ID NO: 72192 - RNA, 1701 nt, Artificial Sequence; identical to SEQ ID NO: 61638
  derived and/or modified sequence opt1 from hemagglutinin__InfluenzaA__AHL89030

SEQ ID NO: 72193 - RNA, 1701 nt, Artificial Sequence
  derived and/or modified sequence opt1 from hemagglutinin__InfluenzaA__AHL89042
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagaacuucaacuggaccggggugacccagaacggcaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccuggucggcuucaucaugugggccugccagaaggggaacauccggugcaacaucugcaucuga

SEQ ID NO: 72194 - RNA, 1701 nt, Artificial Sequence
  derived and/or modified sequence opt1 from hemagglutinin__InfluenzaA__AHL89054
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaugagcugcuuccuccugugcguggcccugcucggguucaucaugugggccugccagaagggcaacauccggugcaacaucugcaucuga

SEQ ID NO: 72195 - RNA, 1701 nt, Artificial Sequence; identical to SEQ ID NO: 62589
  derived and/or modified sequence opt1 from hemagglutinin__InfluenzaA__AHL89066

SEQ ID NO: 72196 - RNA, 1701 nt, Artificial Sequence
  derived and/or modified sequence opt1 from hemagglutinin__InfluenzaA__AHL89078
augaagaccaucaucgcccugagcuacauccucugccugguguucgcccagaagcugcccggcgacgacaacuccaccgcgacgcucugccuggggcaccacgccgucccgaacggcaccguggugaagaccaucaccaacgaccagaucgaggucacgaacgccaccgagcuggugcagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgucccggacuacgcgagccugcggucccucguggccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucuuccuguacgcgcaggccagcggccggaucaccguguccacgaagcgcagccagcagaccgucaucccgaacaucggcagccggccccgcgugcggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 72197 - RNA, 1701 nt, Artificial Sequence
  derived and/or modified sequence opt1 from hemagglutinin__InfluenzaA__AHL89090
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacucccccuaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 72198 - RNA, 1701 nt, Artificial Sequence; identical to SEQ ID NO: 61638
  derived and/or modified sequence opt1 from hemagglutinin__InfluenzaA__AHL89102

SEQ ID NO: 72199 - RNA, 1701 nt, Artificial Sequence; identical to SEQ ID NO: 61638
  derived and/or modified sequence opt1 from hemagglutinin__InfluenzaA__AHL89114

SEQ ID NO: 72200 - RNA, 1701 nt, Artificial Sequence
  derived and/or modified sequence opt1 from hemagglutinin__InfluenzaA__AHL89126
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagaacuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugagcacgaagcgcucccagcagaccgugaucccgaacaucggcagccggccccgcguccggaacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 72201 - RNA, 1701 nt, Artificial Sequence
  derived and/or modified sequence opt1 from hemagglutinin__InfluenzaA__AHL89138
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcagagcuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 72202 - RNA, 1701 nt, Artificial Sequence
  derived and/or modified sequence opt1 from hemagglutinin__InfluenzaA__AHL89150
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucgucuucaucaugugggccugccagaaggggaacauccggugcaacaucugcaucuga

SEQ ID NO: 72203 - RNA, 1701 nt, Artificial Sequence
  derived and/or modified sequence opt1 from hemagglutinin__InfluenzaA__AHL89162
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaccaaccagaucaacggcaagcugaaccggcucaucggcaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 72204 - RNA, 1701 nt, Artificial Sequence
  derived and/or modified sequence opt1 from hemagglutinin__InfluenzaA__AHL89174
augaagaccaucaucgcccugagcuacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacccuggaguucaacaacgagagcuucaacuggaccggcgugacccagaacgggacguccagcgccugcaagcgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucacgguguccaccaagcgcagccagcagaccgugaucccgaacaucggcagccggccccgcguccggaacauccccucccgcaucagcaucuacuggaccaucgugaagcccggggacauccugcucaucaacuccacgggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 72205 - RNA, 1701 nt, Artificial Sequence
  derived and/or modified sequence opt1 from hemagglutinin__InfluenzaA__AHL89210
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 72206 - RNA, 1701 nt, Artificial Sequence; identical to SEQ ID NO: 72205
  derived and/or modified sequence opt1 from hemagglutinin__InfluenzaA__AHL89222

SEQ ID NO: 72207 - RNA, 1701 nt, Artificial Sequence
  derived and/or modified sequence opt1 from hemagglutinin__InfluenzaA__AHL89234
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaugggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 72208 - RNA, 1701 nt, Artificial Sequence
  derived and/or modified sequence opt1 from hemagglutinin__InfluenzaA__AHL89246
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgggaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 72209 - RNA, 1701 nt, Artificial Sequence
  derived and/or modified sequence opt1 from hemagglutinin__InfluenzaA__AHL89258
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccaggcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugauccccaacaucggcagccggccgcgcguccggaacauccccucccgcaucagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 72210 - RNA, 1701 nt, Artificial Sequence; identical to SEQ ID NO: 72205
  derived and/or modified sequence opt1 from hemagglutinin__InfluenzaA__AHL89270

SEQ ID NO: 72211 - RNA, 1701 nt, Artificial Sequence; identical to SEQ ID NO: 72205
  derived and/or modified sequence opt1 from hemagglutinin__InfluenzaA__AHL89282

SEQ ID NO: 72212 - RNA, 1701 nt, Artificial Sequence; identical to SEQ ID NO: 72205
  derived and/or modified sequence opt1 from hemagglutinin__InfluenzaA__AHL89294

SEQ ID NO: 72213 - RNA, 1701 nt, Artificial Sequence; identical to SEQ ID NO: 72205
  derived and/or modified sequence opt1 from hemagglutinin__InfluenzaA__AHL89306

SEQ ID NO: 72214 - RNA, 1701 nt, Artificial Sequence; identical to SEQ ID NO: 62589
  derived and/or modified sequence opt1 from hemagglutinin__InfluenzaA__AHL89318

SEQ ID NO: 72215 - RNA, 1701 nt, Artificial Sequence
  derived and/or modified sequence opt1 from hemagglutinin__InfluenzaA__AHL89330
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 72216 - RNA, 1701 nt, Artificial Sequence; identical to SEQ ID NO: 61638
  derived and/or modified sequence opt1 from hemagglutinin__InfluenzaA__AHL89342

SEQ ID NO: 72217 - RNA, 1701 nt, Artificial Sequence; identical to SEQ ID NO: 62569
  derived and/or modified sequence opt1 from hemagglutinin__InfluenzaA__AHL89354

SEQ ID NO: 72218 - RNA, 1701 nt, Artificial Sequence
  derived and/or modified sequence opt1 from hemagglutinin__InfluenzaA__AHL89366
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugaaguccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucaaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggaucgagcugaaguccggcuacaaggacuggauccuguggaucuccuucgccaucagcugcuuccuccugugcguggugcugcucggcuucaucaugugggccugccagaaggggaacauccgcugcaacaucugcaucuga

SEQ ID NO: 72219 - RNA, 1701 nt, Artificial Sequence; identical to SEQ ID NO: 72205
  derived and/or modified sequence opt1 from hemagglutinin__InfluenzaA__AHL89378

SEQ ID NO: 72220 - RNA, 1701 nt, Artificial Sequence; identical to SEQ ID NO: 62836
  derived and/or modified sequence opt1 from hemagglutinin__InfluenzaA__AHL89390

SEQ ID NO: 72221 - RNA, 1701 nt, Artificial Sequence; identical to SEQ ID NO: 72205
  derived and/or modified sequence opt1 from hemagglutinin__InfluenzaA__AHL89402

SEQ ID NO: 72222 - RNA, 1701 nt, Artificial Sequence; identical to SEQ ID NO: 62589
  derived and/or modified sequence opt1 from hemagglutinin__InfluenzaA__AHL89414

SEQ ID NO: 72223 - RNA, 1701 nt, Artificial Sequence
  derived and/or modified sequence opt1 from hemagglutinin__InfluenzaA__AHL89426
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccuguucaucaacuccaccgggaaccucaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccucaaguccacccaggcggccaucaaccagaucaacgggaagcugaaccggcugaucggcaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcucugcgugguccugcugggcuucaucaugugggccugccagaaggggaacauccggugcaacaucugcaucuga

SEQ ID NO: 72224 - RNA, 1701 nt, Artificial Sequence; identical to SEQ ID NO: 72205
  derived and/or modified sequence opt1 from hemagglutinin__InfluenzaA__AHL89438

SEQ ID NO: 72225 - RNA, 1701 nt, Artificial Sequence; identical to SEQ ID NO: 72205
  derived and/or modified sequence opt1 from hemagglutinin__InfluenzaA__AHL89450

SEQ ID NO: 72226 - RNA, 1701 nt, Artificial Sequence; identical to SEQ ID NO: 72205
  derived and/or modified sequence opt1 from hemagglutinin__InfluenzaA__AHL89462

SEQ ID NO: 72227 - RNA, 1701 nt, Artificial Sequence; identical to SEQ ID NO: 72205
  derived and/or modified sequence opt1 from hemagglutinin__InfluenzaA__AHL89474

SEQ ID NO: 72228 - RNA, 1701 nt, Artificial Sequence; identical to SEQ ID NO: 62836
  derived and/or modified sequence opt1 from hemagglutinin__InfluenzaA__AHL89486

SEQ ID NO: 72229 - RNA, 1701 nt, Artificial Sequence; identical to SEQ ID NO: 62589
  derived and/or modified sequence opt1 from hemagglutinin__InfluenzaA__AHL89498

SEQ ID NO: 72230 - RNA, 1701 nt, Artificial Sequence; identical to SEQ ID NO: 62589
  derived and/or modified sequence opt1 from hemagglutinin__InfluenzaA__AHL89510

SEQ ID NO: 72231 - RNA, 1701 nt, Artificial Sequence; identical to SEQ ID NO: 62589
  derived and/or modified sequence opt1 from hemagglutinin__InfluenzaA__AHL89522

SEQ ID NO: 72232 - RNA, 1701 nt, Artificial Sequence
  derived and/or modified sequence opt1 from hemagglutinin__InfluenzaA__AHL89534
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggaucgagcugaaguccggcuacaaggacuggauccuguggaucuccuucgccaucagcugcuuccuccugugcguggugcugcucggcuucaucaugugggccugccagaaggggaacauccggugcaacaucugcaucuga

SEQ ID NO: 72233 - RNA, 1698 nt, Artificial Sequence
  derived and/or modified sequence opt1 from hemagglutinin__InfluenzaA__AHL89546
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagagcgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagcggaucgacggcgugaagcuggagagcaugggcgucuaccagauccuggccaucuacagcacgguggccuccagccucgugcugcuggucucccucggggccaucagcuucuggaugugcuccaacggcagccugcagugccgcaucugcaucuga

SEQ ID NO: 72234 - RNA, 1698 nt, Artificial Sequence; identical to SEQ ID NO: 62922
  derived and/or modified sequence opt1 from hemagglutinin__InfluenzaA__AHL89558

SEQ ID NO: 72235 - RNA, 1698 nt, Artificial Sequence; identical to SEQ ID NO: 62922
  derived and/or modified sequence opt1 from hemagglutinin__InfluenzaA__AHL89570

SEQ ID NO: 72236 - RNA, 1698 nt, Artificial Sequence; identical to SEQ ID NO: 62938
  derived and/or modified sequence opt1 from hemagglutinin__InfluenzaA__AHL89582

SEQ ID NO: 72237 - RNA, 1698 nt, Artificial Sequence; identical to SEQ ID NO: 62938
  derived and/or modified sequence opt1 from hemagglutinin__InfluenzaA__AHL89594

SEQ ID NO: 72238 - RNA, 1698 nt, Artificial Sequence; identical to SEQ ID NO: 62938
  derived and/or modified sequence opt1 from hemagglutinin__InfluenzaA__AHL89606

SEQ ID NO: 72239 - RNA, 1698 nt, Artificial Sequence; identical to SEQ ID NO: 62922
  derived and/or modified sequence opt1 from hemagglutinin__InfluenzaA__AHL89618

SEQ ID NO: 72240 - RNA, 1698 nt, Artificial Sequence; identical to SEQ ID NO: 62938
  derived and/or modified sequence opt1 from hemagglutinin__InfluenzaA__AHL89630

SEQ ID NO: 72241 - RNA, 1698 nt, Artificial Sequence
  derived and/or modified sequence opt1 from hemagglutinin__InfluenzaA__AHL89642
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgcgagcagcucagcuccgugagcuccuucgagcgguucgagaucuucccgaaggagagcuccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccaugggggagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcucaaccgcgagaagaucgacggcgugaagcuggagagcaugggggucuaccagauccuggccaucuacuccacgguggccagcagccucgugcugcuggucucccucggcgccaucagcuucuggaugugcuccaacgggagccugcagugccggaucugcaucuga

SEQ ID NO: 72242 - RNA, 1698 nt, Artificial Sequence; identical to SEQ ID NO: 62953
  derived and/or modified sequence opt1 from hemagglutinin__InfluenzaA__AHL89654

SEQ ID NO: 72243 - RNA, 1698 nt, Artificial Sequence
  derived and/or modified sequence opt1 from hemagglutinin__InfluenzaA__AHL89666
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgcgagcagcucagcuccgugagcuccuucgagcgguucgagaucuucccgaaggagagcuccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccaugggggagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgcggaggagaucggcaacgggugcuucgaguucuaccacaagugcaacgacgagugcauggaguccgugaagaacggcaccuacgacuaccccaaguacagcgaggaguccaagcucaaccgcgagaagaucgacggcgugaagcuggagagcaugggggucuaccagauccuggccaucuacuccacgguggccagcagccucgugcugcuggucucccucggcgccaucagcuucuggaugugcuccaacgggagccugcagugccggaucugcaucuga

SEQ ID NO: 72244 - RNA, 1698 nt, Artificial Sequence
  derived and/or modified sequence opt1 from hemagglutinin__InfluenzaA__AHL89678
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccaugggggagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcucaaccgcaagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 72245 - RNA, 1698 nt, Artificial Sequence
  derived and/or modified sequence opt1 from hemagglutinin__InfluenzaA__AHL89690
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccgaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 72246 - RNA, 1698 nt, Artificial Sequence; identical to SEQ ID NO: 62953
  derived and/or modified sequence opt1 from hemagglutinin__InfluenzaA__AHL89702

SEQ ID NO: 72247 - RNA, 1698 nt, Artificial Sequence; identical to SEQ ID NO: 62922
  derived and/or modified sequence opt1 from hemagglutinin__InfluenzaA__AHL89714

SEQ ID NO: 72248 - RNA, 1698 nt, Artificial Sequence
  derived and/or modified sequence opt1 from hemagglutinin__InfluenzaA__AHL89726
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagaaggcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcaccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 72249 - RNA, 1698 nt, Artificial Sequence
  derived and/or modified sequence opt1 from hemagglutinin__InfluenzaA__AHL89750
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgggugcgacgcgaagugccagacgccccagggcgccaucaacagcucccugcccuuccagaacguccacccggugaccaucggggagugccccaaguacgugcggagcaccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgccgcggaccagaaguccacccagaacgccaucaacgggaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgccaaggagaucggcaacgggugcuucgaguucuaccacaagugcaacgacgagugcauggagagcgugaagaacggcacguacgacuaccccaaguacuccgaggagagcaagcucaaccgcgagaagaucgacggcgugaagcuggaguccaugggggucuaccagauccuggcgaucuacagcaccguggccagcucccucgugcugcuggucagccucggcgccaucuccuucuggaugugcagcaacgggucccugcagugccggaucugcaucuga

SEQ ID NO: 72250 - RNA, 1698 nt, Artificial Sequence; identical to SEQ ID NO: 62918
  derived and/or modified sequence opt1 from hemagglutinin__InfluenzaA__AHL89762

SEQ ID NO: 72251 - RNA, 1698 nt, Artificial Sequence; identical to SEQ ID NO: 62964
  derived and/or modified sequence opt1 from hemagglutinin__InfluenzaA__AHL89774

SEQ ID NO: 72252 - RNA, 1698 nt, Artificial Sequence; identical to SEQ ID NO: 62953
  derived and/or modified sequence opt1 from hemagglutinin__InfluenzaA__AHL89786

SEQ ID NO: 72253 - RNA, 1698 nt, Artificial Sequence
  derived and/or modified sequence opt1 from hemagglutinin__InfluenzaA__AHL89798
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugagcuccuucgagcgcuucgagaucuucccgaaggagagcuccuggcccaaccacaccgucaccggggugagcgccuccugcagccacaacggcaaguccagcuucuaccggaaccugcuguggcucaccgggaagaacggccuguaccccaaccugucccgcagcuacgccaacaacaaggagaaggaggugcucguccuguggggcgugcaccacccgcccuccaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 72254 - RNA, 1698 nt, Artificial Sequence
  derived and/or modified sequence opt1 from hemagglutinin__InfluenzaA__AHL89810
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccaugggggagugcgacgcggagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 72255 - RNA, 1698 nt, Artificial Sequence
  derived and/or modified sequence opt1 from hemagglutinin__InfluenzaA__AHL89822
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugagcuccuucgagcgcuucgagaucuucccgaaggagagcuccuggcccaaccacaccgucaccggggugagcgccuccugcagccacaacggcaaguccagcuucuaccggaaccugcuguggcucaccgggaagaacggccuguaccccaaccuguccaagagcuacgccaacaacaaggagaaggaggugcucguccuguggggcgugcaccacccgcccaacaucggggaccagcgcgcccuguaccacacggagaacgccuacguguccgucgugagcagccacuacucccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucagccggggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagagcaugggcgucuaccagauccuggccaucuacuccacgguggccagcagccucgugcugcuggucucccucggggccaucagcuucuggaugugcuccaacggcagccugcagugccgcaucugcaucuga

SEQ ID NO: 72256 - RNA, 1698 nt, Artificial Sequence
  derived and/or modified sequence opt1 from hemagglutinin__InfluenzaA__AHL89834
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcaacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggggacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 72257 - RNA, 1698 nt, Artificial Sequence; identical to SEQ ID NO: 62964
  derived and/or modified sequence opt1 from hemagglutinin__InfluenzaA__AHL89846

SEQ ID NO: 72258 - RNA, 1701 nt, Artificial Sequence; identical to SEQ ID NO: 62936
  derived and/or modified sequence opt1 from hemagglutinin__InfluenzaA__AHL89858

SEQ ID NO: 72259 - RNA, 1701 nt, Artificial Sequence; identical to SEQ ID NO: 62936
  derived and/or modified sequence opt1 from hemagglutinin__InfluenzaA__AHL89870

SEQ ID NO: 72260 - RNA, 1701 nt, Artificial Sequence
  derived and/or modified sequence opt1 from hemagglutinin__InfluenzaA__AHL89882
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcggcuccgacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccugcucaucaacuccaccgggaaccugaucgccccgcgcggcuacuucaagauccggagcggcaaguccagcaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccugaaguccacccaggcggccaucaaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaagggcguggagcugaaguccggguacaaggacuggauccuguggaucuccuucgccaucagcugcuuccuccugugcguggcccugcucggcuucaucaugugggccugccagaaggggaacauccgcugcaacaucugcaucuga

SEQ ID NO: 72261 - RNA, 1701 nt, Artificial Sequence; identical to SEQ ID NO: 62936
  derived and/or modified sequence opt1 from hemagglutinin__InfluenzaA__AHL89894

SEQ ID NO: 72262 - RNA, 1701 nt, Artificial Sequence
  derived and/or modified sequence opt1 from hemagglutinin__InfluenzaA__AHL89906
augaagaccaucaucgcccugagcuacauccucugccugguguacgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacugggccggggugacccagaacggcaccuccagcgccugcaagcgcggguccaacaacagcuucuucucccggcugaacuggcucacccacagcaaguucaaguaccccgcgcugaacgugacgaugcccaacaacgaggaguucgacaagcuguacaucuggggcguccaccaccccgggaccgacaacgaccagaucuuccucuacgcccaggccuccggccgcaucaccgugagcaccaagcggagccagcagacggugaucccgaacaucggcucccgcccccggguccgcaacauccccagccggaucuccaucuacuggaccaucgugaagcccggggacauccugcugaucaacagcaccggcaaccucaucgccccgcgcggguacuucaagauccgguccggcaagagcuccaucaugcgcagcgacgcccccaucggcaagugcaacuccgagugcaucacccccaacgggagcauccccaacgacaagccguuccagaacgugaaccggaucacguacggcgcgugcccccgcuacguccggcagaacacccugaagcuggccaccgggaugcgcaacgugcccgagaagcagacccggggcaucuucggggccaucgccggcuucaucgagaacggcugggaggggaugguggacggcugguacggguuccgccaccagaacuccgagggcaucgggcaggccgcggaccucaagagcacgcaggccgccaucgaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgggagaacgcggaggacaugggcaacgggugcuucaagaucuaccacaagugcgacaacgccugcaucggcagcauccgcaacgggaccuacgaccacgacgucuaccgcgacgaggcccugaacaaccgguuccagaucaagggcguggagcucaaguccggcuacaaggacuggauccuguggaucagcuucgccaucuccugcuuccugcucugcguggcccugcugggguucaucaugugggcgugccagaagggcaacauccgcugcaacaucugcaucuga

SEQ ID NO: 72263 - RNA, 1701 nt, Artificial Sequence
  derived and/or modified sequence opt1 from hemagglutinin__InfluenzaA__AHL89918
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaccuuccuguacgcgcaggccagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccagagcgggaaguccagcaucaugcgcuccgacgcccccaucggcaagugcaacagcgagugcaucacccccaacggcuccauccccaacgacaagccguuccagaacgugaaccggaucaccuacggggccugcccccgcuacgucaagcagaacacccugaagcucgcgacgggcaugcggaacgugcccgagaagcagacccgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 72264 - RNA, 1701 nt, Artificial Sequence
  derived and/or modified sequence opt1 from hemagglutinin__InfluenzaA__AHL89930
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacugggccggcgugacccagaacgggaccuccagcgccugcaagcgcggcuccaacaacagcuucuucucccggcugaacuggcucacccacagcaaguucaaguaccccgcgcugaacgugacgaugcccaacaacgaggaguucgacaagcuguacaucuggggcguccaccaccccgggaccgacaacgaccagaucuuccucuacgcccaggccuccggccgcaucaccgugagcaccaagcggagccagcagacggugaucccgaacaucgggucccgcccccggguccgcaacauccccagccggaucuccaucuacuggaccaucgugaagcccggcgacauccugcugaucaacagcaccgggaaccucaucgccccgcgcggcuacuucaagauccgguccggcaagagcuccaucaugcgcagcgacgcccccaucuccaagugcaacagcgagugcaucacccccaacggguccauccccaacgacaagccguuccagaacgugaaccggaucacguacggcgcgugcccccgcuacgucaagcagaacacccugaagcuggccaccgggaugcggaacgugcccgagaagcagacccgcggcaucuucggggccaucgccggcuucaucgagaacggcugggaggggaugguggacggcugguacggguuccggcaccagaacagcgagggcauggggcaggccgcggaccucaaguccacgcaggccgccaucgaccagaucaacggcaagcugaaccgccugaucggcaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacagcgagaugaacaagcuguucgagaagaccaagaagcagcuccgcgagaacgcggaggacaugggcaacgggugcuucaagaucuaccacaagugcgacaacgccugcaucggcuccauccggaacgggaccuacgaccacgacgucuaccgcgacgaggcccugaacaaccgcuuccagaucaagggcguggagcucaagagcggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 72265 - RNA, 1701 nt, Artificial Sequence; identical to SEQ ID NO: 62923
  derived and/or modified sequence opt1 from hemagglutinin__InfluenzaA__AHL89942

SEQ ID NO: 72266 - RNA, 1701 nt, Artificial Sequence
  derived and/or modified sequence opt1 from hemagglutinin__InfluenzaA__AHL89954
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggaccacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 72267 - RNA, 1701 nt, Artificial Sequence; identical to SEQ ID NO: 62936
  derived and/or modified sequence opt1 from hemagglutinin__InfluenzaA__AHL89966

SEQ ID NO: 72268 - RNA, 1701 nt, Artificial Sequence; identical to SEQ ID NO: 62936
  derived and/or modified sequence opt1 from hemagglutinin__InfluenzaA__AHL89978

SEQ ID NO: 72269 - RNA, 1701 nt, Artificial Sequence; identical to SEQ ID NO: 62995
  derived and/or modified sequence opt1 from hemagglutinin__InfluenzaA__AHL89990

SEQ ID NO: 72270 - RNA, 1701 nt, Artificial Sequence
  derived and/or modified sequence opt1 from hemagglutinin__InfluenzaA__AHL90002
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacugggccggcgugacccagaacgggaccuccagcgccugcaagcgcggcuccaacaacagcuucuucucccggcugaacuggcucacccacagcaaguucaaguaccccgcgcugaacgugacgaugcccaacaacgaggaguucgacaagcuguacaucuggggcguccaccaccccgggaccgacaacgaccagaucuuccucuacgcccaggccuccggccgcaucaccgugagcaccaagcggagccagcagacggugaucccgaacaucgggucccgcccccggguccgcaacauccccagccggaucuccaucuacuggaccaucgugaagcccggcgacauccugcugaucaacagcaccgggaaccucaucgccccgcgcggcuacuucaagauccgguccggcaagagcuccaucaugcgcagcgacgcccccaucgggaagugcaacuccgagugcaucacccccaacggcagcauccccaacgacaagccguuccagaacgugaaccggaucacguacggggcgugcccccgcuacgucaagcagaacacccugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaugggccaggccgcggaccucaagagcacgcaggccgccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccggaacggcaccuacgaccacgacgucuaccgcgacgaggcccugaacaaccgcuuccagaucaagggcguggagcucaaguccggguacaaggacuggauccuguggaucagcuucgccaucuccugcuuccugcucugcguggcccugcugggcuucaucaugugggcgugccagaaggggaacauccggugcaacaucugcaucuga

SEQ ID NO: 72271 - RNA, 1701 nt, Artificial Sequence
  derived and/or modified sequence opt1 from hemagglutinin__InfluenzaA__AHL90014
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagguggaggucacgaacgccaccgagcuggugcagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucuuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 72272 - RNA, 1701 nt, Artificial Sequence; identical to SEQ ID NO: 72271
  derived and/or modified sequence opt1 from hemagglutinin__InfluenzaA__AHL90026

SEQ ID NO: 72273 - RNA, 1701 nt, Artificial Sequence
  derived and/or modified sequence opt1 from hemagglutinin__InfluenzaA__AHL90050
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacgccgagaugaacaagcuguucgagaagaccaagaagcagcugcgggagaacgcggaggacauggggaacggcugcuucaagaucuaccacaagugcgacaacgccugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 72274 - RNA, 1701 nt, Artificial Sequence
  derived and/or modified sequence opt1 from hemagglutinin__InfluenzaA__AHL90062
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacggggagaacugcacccugaucgacgcccugcucggcgacccccagugcgacggguuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggcgugacccagaacgggaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucgggagccggccccgcguccggaacauccccucccgcaucagcaucuacuggaccaucgugaagcccggcgacauccugcucaucaacuccaccggcaaccugaucgccccgcggggguacuucaagauccgcagcggcaaguccagcaucaugcgguccgacgcccccaucgggaagugcaacagcgagugcaucacgcccaacggcuccauccccaacuacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacgggugggagggcaugguggacggcugguacggguuccgccaccagaacagcgagggcaucgggcaggccgccgaccugaaguccacccaggcggccaucgaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggguacaaggacuggauccuguggaucuccuucgccaucagcugcuuccuccugugcguggcccugcucggcuucaucaugugggccugccagaagggcaacauccgcugcaacaucugcaucuga

SEQ ID NO: 72275 - RNA, 1701 nt, Artificial Sequence; identical to SEQ ID NO: 62936
  derived and/or modified sequence opt1 from hemagglutinin__InfluenzaA__AHL90074

SEQ ID NO: 72276 - RNA, 1701 nt, Artificial Sequence
  derived and/or modified sequence opt1 from hemagglutinin__InfluenzaA__AHL90086
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguacaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 72277 - RNA, 1701 nt, Artificial Sequence
  derived and/or modified sequence opt1 from hemagglutinin__InfluenzaA__AHL90098
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcggcuccgacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccugcucaucaacuccaccgggaaccugaucgccccgcgcggcuacuucaagauccggagcggcaaguccagcaucaugcgcuccgacgcccccaucgacaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 72278 - RNA, 1701 nt, Artificial Sequence
  derived and/or modified sequence opt1 from hemagglutinin__InfluenzaA__AHL90110
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccagagcgggaaguccagcgugaugcgcuccgacgcccccaucggcaagugcaacagcgagugcaucacgcccaacggcuccauccccaacgacaagccguuccagaacgucaaccggaucaccuacggggccugcccccgcuacgugaagcagaacacccugaagcucgcgaccggcaugcggaacgugcccgagaagcagacgcgcgggaucuucggcgccaucgccggguucaucgagaacggcugggagggcauggucgacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 72279 - RNA, 1698 nt, Artificial Sequence; identical to SEQ ID NO: 65103
  derived and/or modified sequence opt1 from hemagglutinin__InfluenzaA__AHL90122

SEQ ID NO: 72280 - RNA, 1698 nt, Artificial Sequence; identical to SEQ ID NO: 63496
  derived and/or modified sequence opt1 from hemagglutinin__InfluenzaA__AHL90133

SEQ ID NO: 72281 - RNA, 1698 nt, Artificial Sequence; identical to SEQ ID NO: 65103
  derived and/or modified sequence opt1 from hemagglutinin__InfluenzaA__AHL90145

SEQ ID NO: 72282 - RNA, 1698 nt, Artificial Sequence
  derived and/or modified sequence opt1 from hemagglutinin__InfluenzaA__AHL90157
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagauccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggccaucuacuccaccaucgccagcagccuggugcuccuggugucccugggggccaucagcuucuggaugugcuccaacggcagccuccagugccggaucugcaucuga

SEQ ID NO: 72283 - RNA, 1698 nt, Artificial Sequence; identical to SEQ ID NO: 65103
  derived and/or modified sequence opt1 from hemagglutinin__InfluenzaA__AHL90169

SEQ ID NO: 72284 - RNA, 1698 nt, Artificial Sequence
  derived and/or modified sequence opt1 from hemagglutinin__InfluenzaA__AHL90181
augaaggugaagcugcucguccugcugugcaccuucgccgccaccuacgcggacacgaucugcaucggcuaccacgccaacaacagcaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccaagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacccccgagaucgcgaagcgccccaaggugcgggaccaggagggccgcaucaacuacuacuggacgcuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuucaucgacaucuggaccuacaacgcggagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 72285 - RNA, 1698 nt, Artificial Sequence; identical to SEQ ID NO: 64178
  derived and/or modified sequence opt1 from hemagglutinin__InfluenzaA__AHL90217

SEQ ID NO: 72286 - RNA, 1698 nt, Artificial Sequence; identical to SEQ ID NO: 64178
  derived and/or modified sequence opt1 from hemagglutinin__InfluenzaA__AHL90229

SEQ ID NO: 72287 - RNA, 1698 nt, Artificial Sequence
  derived and/or modified sequence opt1 from hemagglutinin__InfluenzaA__AHL90241
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugauccccaaggagagcugguccuacaucguggagaagcccaaccccgagaacgggaccugcuacccgggccacuucgccgacuacgaggagcugcgcgagcagcucagcuccgugagcuccuucgagcgguucgagaucuuccccaaggagagcuccuggcccaaccacacggucaccggggugagcgccuccugcagccacaacggcgaguccagcuucuaccgcaaccugcuguggcucaccgggaagaacggccuguaccccaaccuguccaagagcuacgccaacaacaaggagaaggaggugcucguccuguggggcgugcaccacccgcccaacaucggcgaccagaaggcccuguaccacaccgagaacgccuacguguccgucgugagcagccacuacucccggaaguucacgcccgagaucgccaagcgccccaaggugcgggaccaggagggccgcaucaacuacuacuggacccuccuggagccgggggacaccaucaucuucgaggcgaacggcaaccugaucgcgccccgguacgccuucgcccucagccgcggguucggcuccggcaucaucaacagcaacgcccccauggacaagugcgacgccaagugccagacgccccagggggccaucaacuccagccugccguuccagaacguccaccccgugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuacccgaaguacagcgaggaguccaagcugaaccgcgagaagaucgacggcgugaagcucgagagcaugggcgucuaccagauccuggccaucuacuccaccguggccagcagccuggugcuccuggucucccugggggccaucagcuucuggaugugcuccaacggcagccuccagugccggaucugcaucuga

SEQ ID NO: 72288 - RNA, 1698 nt, Artificial Sequence
  derived and/or modified sequence opt1 from hemagglutinin__InfluenzaA__AHL90253
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaagggguccagcuggcccaaccacacggucaccggcguguccgccagcugcucccacaacggggagagcuccuucuaccgcaaccugcuguggcucaccggcaagaacgggcuguaccccaaccugagcaaguccuacgccaacaacaaggagaaggaggugcucguccuguggggcgugcaccacccgcccaacaucggcgaccagaagacccuguaccacacggagaacgccuacgugagcgucgugagcucccacuacagccggaaguucacccccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucucccgcggcuucggcagcgggaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggcuggaccgggaugguggacggcugguacggguaccaccaccagaacgagcagggcuccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggugagcaagcugaaccgcgagaagaucgacggcgucaagcucgaguccauggggguguaccagauccuggcgaucuacagcaccguggccagcucccugguccuccuggugagccugggcgccaucuccuucuggaugugcagcaacgggucccuccagugccggaucugcaucuga

SEQ ID NO: 72289 - RNA, 1698 nt, Artificial Sequence; identical to SEQ ID NO: 63496
  derived and/or modified sequence opt1 from hemagglutinin__InfluenzaA__AHL90265

SEQ ID NO: 72290 - RNA, 1698 nt, Artificial Sequence
  derived and/or modified sequence opt1 from hemagglutinin__InfluenzaA__AHL90277
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccacacggagaacgccuacgucagcguggugagcucccacuacagccggaaguucacccccgagaucgccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggucaagcucgaguccaugggcguguaccagauccuggcgaucuacagcaccguggccagcucccugguccuccuggugagccugggcgccaucuccuucuggaugugcagcaacgggucccuccagugccggaucugcaucuga

SEQ ID NO: 72291 - RNA, 1698 nt, Artificial Sequence
  derived and/or modified sequence opt1 from hemagglutinin__InfluenzaA__AHL90289
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagccccgggacaccaucaucuucgaggcgaacgggaaccugaucgccccgcgcuacgccuucgcccucucccggggcuucgggagcggcaucaucaacuccaacgcccccauggacaagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacagcgucaucgagaagaugaacacccaguucaccgccgugggcaaggaguucaacaagcuggagcgccggauggagaaccucaacaagaaggucgacgacggguucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgggagaagaucgacggggugaagcucgaguccaugggcgucuaccagauccuggccaucuacagcaccguggccagcucccuggugcuccuggucagccugggcgccaucuccuucuggaugugcagcaacgggucccuccagugccgcaucugcaucuga

SEQ ID NO: 72292 - RNA, 1698 nt, Artificial Sequence; identical to SEQ ID NO: 72291
  derived and/or modified sequence opt1 from hemagglutinin__InfluenzaA__AHL90301

SEQ ID NO: 72293 - RNA, 1698 nt, Artificial Sequence
  derived and/or modified sequence opt1 from hemagglutinin__InfluenzaA__AHL90325
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagauggggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 72294 - RNA, 1698 nt, Artificial Sequence; identical to SEQ ID NO: 72293
  derived and/or modified sequence opt1 from hemagglutinin__InfluenzaA__AHL90337

SEQ ID NO: 72295 - RNA, 1698 nt, Artificial Sequence; identical to SEQ ID NO: 63496
  derived and/or modified sequence opt1 from hemagglutinin__InfluenzaA__AHL90349

SEQ ID NO: 72296 - RNA, 1698 nt, Artificial Sequence; identical to SEQ ID NO: 63496
  derived and/or modified sequence opt1 from hemagglutinin__InfluenzaA__AHL90361

SEQ ID NO: 72297 - RNA, 1698 nt, Artificial Sequence; identical to SEQ ID NO: 72290
  derived and/or modified sequence opt1 from hemagglutinin__InfluenzaA__AHL90373

SEQ ID NO: 72298 - RNA, 1701 nt, Artificial Sequence
  derived and/or modified sequence opt1 from hemagglutinin__InfluenzaA__AHL90385
augaagaccaucaucgcccugagcuacauccagugccucguguucgcccagaaguuccccggcaacgacaacuccaccgcgacgcugugccuggggcaccacgccgucccgaacggcaccaucgugaagaccaucaccaacgaccagaucgaggugacgaacgccaccgagcucguccagagcuccagcaccggggagaucugcgacagcccccaccagauccuggacggcgagaacugcacccugaucgacgcccuccugggggacccccagugcgacggcuuccagaacaagaacugggaccuguucguggagcgcagcaaggccuacuccaacugcuaccccuacgacgugccggacuacgcgagccuccggucccuggucgccagcuccggcacgcuggaguucaacaacgagagcuucaacuggaccggggugacccagaacggcaccuccagcgccugcauccgccgguccaacaacagcuucuucucccgccucaacuggcugacgcacagcaaguucaaguaccccgcccugaacgugaccaugcccaacaacgagaacuucgacaagcucuacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggccgcaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcaucgcccugcucggcuucaucaugugggccugccagaaggggaacauccggugcaacaucugcaucuga

SEQ ID NO: 72299 - RNA, 1701 nt, Artificial Sequence
  derived and/or modified sequence opt1 from hemagglutinin__InfluenzaA__AHL90397
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcagcuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 72300 - RNA, 1701 nt, Artificial Sequence; identical to SEQ ID NO: 63442
  derived and/or modified sequence opt1 from hemagglutinin__InfluenzaA__AHL90410

SEQ ID NO: 72301 - RNA, 1701 nt, Artificial Sequence
  derived and/or modified sequence opt1 from hemagglutinin__InfluenzaA__AHL90422
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugagcaagcuguucgagaagaccaagaagcagcuccgggagaacgccgaggacauggggaacggcugcuucaagaucuaccacaagugcgacaacacgugcaucggguccauccgcaacggcaccuacgaccacaacgucuaccgcgacgaggcgcugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 72302 - RNA, 1701 nt, Artificial Sequence; identical to SEQ ID NO: 63442
  derived and/or modified sequence opt1 from hemagglutinin__InfluenzaA__AHL90434

SEQ ID NO: 72303 - RNA, 1701 nt, Artificial Sequence; identical to SEQ ID NO: 63442
  derived and/or modified sequence opt1 from hemagglutinin__InfluenzaA__AHL90446

SEQ ID NO: 72304 - RNA, 1701 nt, Artificial Sequence
  derived and/or modified sequence opt1 from hemagglutinin__InfluenzaA__AHL90458
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcgcccugaucgacgcccugcucggggacccccagugcgacggcuuccagaacaagaagugggaccuguucguggagcgcagcaaggcguacuccaacugcuaccccuacgacgugccggacuacgccagccugcggucccucgucgccagcuccggcacccuggaguucaacaacgagagcuucaacuggacgggggugacccagaacggcaccuccagcgccugcauccgccgguccaacaacagcuucuucucccgccugaacuggcucacccaccugaaguucaaguaccccgcgcugaacgugacgaugcccaacaacgagcaguucgacaagcucuacaucuggggcguccaccaccccgggaccgacaacgaccagaucuuccuguacgcccaggccagcgggcggaucaccguguccaccaagcgcagccagcagacggugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 72305 - RNA, 1701 nt, Artificial Sequence; identical to SEQ ID NO: 63442
  derived and/or modified sequence opt1 from hemagglutinin__InfluenzaA__AHL90470

SEQ ID NO: 72306 - RNA, 1701 nt, Artificial Sequence; identical to SEQ ID NO: 63442
  derived and/or modified sequence opt1 from hemagglutinin__InfluenzaA__AHL90482

SEQ ID NO: 72307 - RNA, 1701 nt, Artificial Sequence; identical to SEQ ID NO: 63545
  derived and/or modified sequence opt1 from hemagglutinin__InfluenzaA__AHL90494

SEQ ID NO: 72308 - RNA, 1701 nt, Artificial Sequence; identical to SEQ ID NO: 63545
  derived and/or modified sequence opt1 from hemagglutinin__InfluenzaA__AHL90506

SEQ ID NO: 72309 - RNA, 1701 nt, Artificial Sequence
  derived and/or modified sequence opt1 from hemagglutinin__InfluenzaA__AHL90518
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaagaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaaggagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaccggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 72310 - RNA, 1701 nt, Artificial Sequence; identical to SEQ ID NO: 64221
  derived and/or modified sequence opt1 from hemagglutinin__InfluenzaA__AHL90530

SEQ ID NO: 72311 - RNA, 1701 nt, Artificial Sequence; identical to SEQ ID NO: 63442
  derived and/or modified sequence opt1 from hemagglutinin__InfluenzaA__AHL90542

SEQ ID NO: 72312 - RNA, 1701 nt, Artificial Sequence; identical to SEQ ID NO: 63442
  derived and/or modified sequence opt1 from hemagglutinin__InfluenzaA__AHL90554

SEQ ID NO: 72313 - RNA, 1701 nt, Artificial Sequence; identical to SEQ ID NO: 63442
  derived and/or modified sequence opt1 from hemagglutinin__InfluenzaA__AHL90566

SEQ ID NO: 72314 - RNA, 1701 nt, Artificial Sequence; identical to SEQ ID NO: 63442
  derived and/or modified sequence opt1 from hemagglutinin__InfluenzaA__AHL90578

SEQ ID NO: 72315 - RNA, 1701 nt, Artificial Sequence; identical to SEQ ID NO: 63545
  derived and/or modified sequence opt1 from hemagglutinin__InfluenzaA__AHL90590

SEQ ID NO: 72316 - RNA, 1701 nt, Artificial Sequence; identical to SEQ ID NO: 63442
  derived and/or modified sequence opt1 from hemagglutinin__InfluenzaA__AHL90602

SEQ ID NO: 72317 - RNA, 1701 nt, Artificial Sequence; identical to SEQ ID NO: 63442
  derived and/or modified sequence opt1 from hemagglutinin__InfluenzaA__AHL90614

SEQ ID NO: 72318 - RNA, 1701 nt, Artificial Sequence
  derived and/or modified sequence opt1 from hemagglutinin__InfluenzaA__AHL90638
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagccggaaguccagcaucaugcgcuccgacgcccccaucgggaagugcaacagcgagugcaucacgcccaacggcuccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacgggugggagggcaugguggacggcugguacggguuccggcaccagaacagcgagggccgcgggcaggccgccgaccugaaguccacccaggcggccaucgaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggguacaaggacuggauccuguggaucuccuucgccaucagcugcuuccuccugugcguggcccugcucggcuucaucaugugggccugccagaagggcaacauccgcugcaacaucugcaucuga

SEQ ID NO: 72319 - RNA, 1701 nt, Artificial Sequence
  derived and/or modified sequence opt1 from hemagglutinin__InfluenzaA__AHL90650
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaccuuccuguacgcgcaggccagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 72320 - RNA, 1701 nt, Artificial Sequence; identical to SEQ ID NO: 63442
  derived and/or modified sequence opt1 from hemagglutinin__InfluenzaA__AHL90662

SEQ ID NO: 72321 - RNA, 1701 nt, Artificial Sequence
  derived and/or modified sequence opt1 from hemagglutinin__InfluenzaA__AHL90674
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgucugcaucggguccauccgcaacggcaccuacgaccacgacguguaccgcgacgaggcgcucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 72322 - RNA, 1701 nt, Artificial Sequence
  derived and/or modified sequence opt1 from hemagglutinin__InfluenzaA__AHL90686
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggccauggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 72323 - RNA, 1701 nt, Artificial Sequence; identical to SEQ ID NO: 63442
  derived and/or modified sequence opt1 from hemagglutinin__InfluenzaA__AHL90698

SEQ ID NO: 72324 - RNA, 1701 nt, Artificial Sequence; identical to SEQ ID NO: 63442
  derived and/or modified sequence opt1 from hemagglutinin__InfluenzaA__AHL90710

SEQ ID NO: 72325 - RNA, 1698 nt, Artificial Sequence; identical to SEQ ID NO: 66980
  derived and/or modified sequence opt1 from hemagglutinin__InfluenzaA__AHL90722

SEQ ID NO: 72326 - RNA, 1698 nt, Artificial Sequence
  derived and/or modified sequence opt1 from hemagglutinin__InfluenzaA__AHL90746
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucaagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 72327 - RNA, 1698 nt, Artificial Sequence; identical to SEQ ID NO: 64139
  derived and/or modified sequence opt1 from hemagglutinin__InfluenzaA__AHL90758

SEQ ID NO: 72328 - RNA, 1698 nt, Artificial Sequence
  derived and/or modified sequence opt1 from hemagglutinin__InfluenzaA__AHL90770
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggacuccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucaacgaccagaagacccuguaccacacggagaacgccuacgugagcgucguguccagccaccacucccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucagccgcggcuucggguccggcaucaucaacagcaacgcccccauggacaagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccugaccaucuacagcacgguggcguccagccuggugcuccuggucucccugggcgccaucagcuucuggaugugcuccaacgggagccuccagugccggaucugcaucuga

SEQ ID NO: 72329 - RNA, 1698 nt, Artificial Sequence; identical to SEQ ID NO: 64624
  derived and/or modified sequence opt1 from hemagglutinin__InfluenzaA__AHL90782

SEQ ID NO: 72330 - RNA, 1698 nt, Artificial Sequence
  derived and/or modified sequence opt1 from hemagglutinin__InfluenzaA__AHL90794
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaacacccuguaccacacggagaacgccuacgugagcgucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacagcaccguggccagcucccuggugcuccuggucagccugggggccaucuccuucuggaugugcagcaacggcucccuccagugccggaucugcaucuga

SEQ ID NO: 72331 - RNA, 1698 nt, Artificial Sequence
  derived and/or modified sequence opt1 from hemagglutinin__InfluenzaA__AHL90806
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggggucaagcucgaguccaugggcguguaccagauccuggcgaucuacagcaccguggccagcucccugguccuccugaucagccugggcgccaucuccuucuggaugugcagcaacgggucccuccagugccgcaucugcaucuga

SEQ ID NO: 72332 - RNA, 1698 nt, Artificial Sequence; identical to SEQ ID NO: 66980
  derived and/or modified sequence opt1 from hemagglutinin__InfluenzaA__AHL90818

SEQ ID NO: 72333 - RNA, 1698 nt, Artificial Sequence; identical to SEQ ID NO: 66980
  derived and/or modified sequence opt1 from hemagglutinin__InfluenzaA__AHL90830

SEQ ID NO: 72334 - RNA, 1698 nt, Artificial Sequence; identical to SEQ ID NO: 64139
  derived and/or modified sequence opt1 from hemagglutinin__InfluenzaA__AHL90842

SEQ ID NO: 72335 - RNA, 1698 nt, Artificial Sequence; identical to SEQ ID NO: 66521
  derived and/or modified sequence opt1 from hemagglutinin__InfluenzaA__AHL90854

SEQ ID NO: 72336 - RNA, 1698 nt, Artificial Sequence; identical to SEQ ID NO: 64139
  derived and/or modified sequence opt1 from hemagglutinin__InfluenzaA__AHL90866

SEQ ID NO: 72337 - RNA, 1698 nt, Artificial Sequence; identical to SEQ ID NO: 66521
  derived and/or modified sequence opt1 from hemagglutinin__InfluenzaA__AHL90878

SEQ ID NO: 72338 - RNA, 1698 nt, Artificial Sequence; identical to SEQ ID NO: 66980
  derived and/or modified sequence opt1 from hemagglutinin__InfluenzaA__AHL90890

SEQ ID NO: 72339 - RNA, 1698 nt, Artificial Sequence; identical to SEQ ID NO: 66521
  derived and/or modified sequence opt1 from hemagglutinin__InfluenzaA__AHL90902

SEQ ID NO: 72340 - RNA, 1698 nt, Artificial Sequence; identical to SEQ ID NO: 64139
  derived and/or modified sequence opt1 from hemagglutinin__InfluenzaA__AHL90914

SEQ ID NO: 72341 - RNA, 1698 nt, Artificial Sequence; identical to SEQ ID NO: 66521
  derived and/or modified sequence opt1 from hemagglutinin__InfluenzaA__AHL90938

SEQ ID NO: 72342 - RNA, 1698 nt, Artificial Sequence; identical to SEQ ID NO: 66521
  derived and/or modified sequence opt1 from hemagglutinin__InfluenzaA__AHL90950

SEQ ID NO: 72343 - RNA, 1698 nt, Artificial Sequence; identical to SEQ ID NO: 66521
  derived and/or modified sequence opt1 from hemagglutinin__InfluenzaA__AHL90962

SEQ ID NO: 72344 - RNA, 1698 nt, Artificial Sequence
  derived and/or modified sequence opt1 from hemagglutinin__InfluenzaA__AHL90974
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacagccggaaguucacccccgagguggccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagggccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgucaagcucgagagcaugggcguguaccagauccuggcgaucuacagcaccguggccuccagccugguccuccuggugucccugggggccaucagcuucuggaugugcuccaacggcagccuccagugccggaucugcaucuga

SEQ ID NO: 72345 - RNA, 1698 nt, Artificial Sequence
  derived and/or modified sequence opt1 from hemagglutinin__InfluenzaA__AHL90986
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugagcguggucagcucccacuacagccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucuccaagggguucggcagcgggaucaucaacuccaacgcccccauggacaagugcgacgccaagugccagacgccccggggcgcgaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaagguggacgacggcuucaucgacaucuggacguacaacgccgagcugcugguccuccuggagaacgagcgcacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccgcaucugcaucuga

SEQ ID NO: 72346 - RNA, 1698 nt, Artificial Sequence
  derived and/or modified sequence opt1 from hemagglutinin__InfluenzaA__AHL91010
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggacuccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucaacgaccagaagacccuguaccacacggagaacgccuacgugagcgucguguccagccacuacucccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucagccgcggcuucggguccggcaucaucaacagcaacgcccccauggacaagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccugaccaucuacagcacgguggcguccagccuggugcuccuggucucccugggcgccaucagcuucuggaugugcuccaacgggagccuccagugccggaucugcaucuga

SEQ ID NO: 72347 - RNA, 1698 nt, Artificial Sequence
  derived and/or modified sequence opt1 from hemagglutinin__InfluenzaA__AHL91022
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggacuccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccuccaucaacgaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccugaccaucuacagcacgguggcgagcucccuggugcuccuggucagccugggcgccaucuccuucuggaugugcagcaacgggucccuccagugccggaucugcaucuga

SEQ ID NO: 72348 - RNA, 1701 nt, Artificial Sequence; identical to SEQ ID NO: 63442
  derived and/or modified sequence opt1 from hemagglutinin__InfluenzaA__AHL91034

SEQ ID NO: 72349 - RNA, 1701 nt, Artificial Sequence; identical to SEQ ID NO: 66508
  derived and/or modified sequence opt1 from hemagglutinin__InfluenzaA__AHL91046

SEQ ID NO: 72350 - RNA, 1701 nt, Artificial Sequence; identical to SEQ ID NO: 72322
  derived and/or modified sequence opt1 from hemagglutinin__InfluenzaA__AHL91058

SEQ ID NO: 72351 - RNA, 1701 nt, Artificial Sequence
  derived and/or modified sequence opt1 from hemagglutinin__InfluenzaA__AHL91070
augaagaccaucaucgcccugagcuacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggacgggggugacccagaacggcaccuccagcgccugcaugcgccgguccaacaacagcuucuucucccgccugaacuggcucacccaccugaaguucaaguaccccgcccugaacgugacgaugcccaacaacgagcaguucgacaagcucuacaucuggggcguccaccaccccgggaccgacaacgaccagaucuuccuguacgcgcaggccagcgggcggaucaccguguccaccaagcgcagccagcagacggugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 72352 - RNA, 1701 nt, Artificial Sequence
  derived and/or modified sequence opt1 from hemagglutinin__InfluenzaA__AHL91082
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugccccaucuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 72353 - RNA, 1701 nt, Artificial Sequence; identical to SEQ ID NO: 66427
  derived and/or modified sequence opt1 from hemagglutinin__InfluenzaA__AHL91094

SEQ ID NO: 72354 - RNA, 1701 nt, Artificial Sequence
  derived and/or modified sequence opt1 from hemagglutinin__InfluenzaA__AHL91106
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaagggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggacgggggugacccagaacggcaccuccagcgccugcauccgccgguccaacaacagcuucuucucccgccugaacuggcucacccaccugaaguucaaguaccccgcccugaacgugacgaugcccaacaacgagcaguucgacaagcucuacaucuggggcguccaccaccccgggaccgacaacgaccagaucuuccuguacgcgcaggccagcgggcggaucaccguguccaccaagcgcagccagcagacggugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 72355 - RNA, 1701 nt, Artificial Sequence
  derived and/or modified sequence opt1 from hemagglutinin__InfluenzaA__AHL91118
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucuccaagcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccuggugacgcuggagaaccagcacaccaucgaccucaccgacagcgagaugaacaagcuguucgagaagaccaagaagcagcugcgggagaacgccgaggacauggggaacggcugcuucaagaucuaccacaagugcgacaacgccugcaucggguccauccgcaacggcacguacgaccacgacgucuaccgcgacgaggcgcucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 72356 - RNA, 1701 nt, Artificial Sequence
  derived and/or modified sequence opt1 from hemagglutinin__InfluenzaA__AHL91130
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucaucgccagcuccggcacgcuggaguucaacaacgagagcuucaacuggaccggggucacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccagcgggcggaucaccgucuccacgaagcgcagccagcagaccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 72357 - RNA, 1701 nt, Artificial Sequence; identical to SEQ ID NO: 63442
  derived and/or modified sequence opt1 from hemagglutinin__InfluenzaA__AHL91142

SEQ ID NO: 72358 - RNA, 1701 nt, Artificial Sequence; identical to SEQ ID NO: 63442
  derived and/or modified sequence opt1 from hemagglutinin__InfluenzaA__AHL91154

SEQ ID NO: 72359 - RNA, 1701 nt, Artificial Sequence; identical to SEQ ID NO: 61638
  derived and/or modified sequence opt1 from hemagglutinin__InfluenzaA__AHL91166

SEQ ID NO: 72360 - RNA, 1701 nt, Artificial Sequence; identical to SEQ ID NO: 71475
  derived and/or modified sequence opt1 from hemagglutinin__InfluenzaA__AHL94984

SEQ ID NO: 72361 - RNA, 1701 nt, Artificial Sequence; identical to SEQ ID NO: 71475
  derived and/or modified sequence opt1 from hemagglutinin__InfluenzaA__AHL94996

SEQ ID NO: 72362 - RNA, 1701 nt, Artificial Sequence; identical to SEQ ID NO: 70843
  derived and/or modified sequence opt1 from hemagglutinin__InfluenzaA__AHL95008

SEQ ID NO: 72363 - RNA, 1701 nt, Artificial Sequence; identical to SEQ ID NO: 71005
  derived and/or modified sequence opt1 from hemagglutinin__InfluenzaA__AHL95020

SEQ ID NO: 72364 - RNA, 1701 nt, Artificial Sequence; identical to SEQ ID NO: 71002
  derived and/or modified sequence opt1 from hemagglutinin__InfluenzaA__AHL95032

SEQ ID NO: 72365 - RNA, 1701 nt, Artificial Sequence; identical to SEQ ID NO: 70876
  derived and/or modified sequence opt1 from hemagglutinin__InfluenzaA__AHL95044

SEQ ID NO: 72366 - RNA, 1701 nt, Artificial Sequence; identical to SEQ ID NO: 70866
  derived and/or modified sequence opt1 from hemagglutinin__InfluenzaA__AHL95056

SEQ ID NO: 72367 - RNA, 1701 nt, Artificial Sequence; identical to SEQ ID NO: 71005
  derived and/or modified sequence opt1 from hemagglutinin__InfluenzaA__AHL95068

SEQ ID NO: 72368 - RNA, 1701 nt, Artificial Sequence; identical to SEQ ID NO: 71553
  derived and/or modified sequence opt1 from hemagglutinin__InfluenzaA__AHL95080

SEQ ID NO: 72369 - RNA, 1701 nt, Artificial Sequence; identical to SEQ ID NO: 70876
  derived and/or modified sequence opt1 from hemagglutinin__InfluenzaA__AHL95092

SEQ ID NO: 72370 - RNA, 1701 nt, Artificial Sequence
  derived and/or modified sequence opt1 from hemagglutinin__InfluenzaA__AHL95104
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcaugcgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 72371 - RNA, 1701 nt, Artificial Sequence
  derived and/or modified sequence opt1 from hemagglutinin__InfluenzaA__AHL95116
augaagaccaucaucgcccugagcuacauccucugccugguguucgcccaggagcugcccggcaacgacgacuccaccgcgacgcucugccuggggcacuacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgaaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 72372 - RNA, 1701 nt, Artificial Sequence; identical to SEQ ID NO: 70843
  derived and/or modified sequence opt1 from hemagglutinin__InfluenzaA__AHL95128

SEQ ID NO: 72373 - RNA, 1701 nt, Artificial Sequence; identical to SEQ ID NO: 70866
  derived and/or modified sequence opt1 from hemagglutinin__InfluenzaA__AHL95140

SEQ ID NO: 72374 - RNA, 1701 nt, Artificial Sequence; identical to SEQ ID NO: 70876
  derived and/or modified sequence opt1 from hemagglutinin__InfluenzaA__AHL95152

SEQ ID NO: 72375 - RNA, 1701 nt, Artificial Sequence; identical to SEQ ID NO: 70843
  derived and/or modified sequence opt1 from hemagglutinin__InfluenzaA__AHL95164

SEQ ID NO: 72376 - RNA, 1701 nt, Artificial Sequence; identical to SEQ ID NO: 70876
  derived and/or modified sequence opt1 from hemagglutinin__InfluenzaA__AHL95176

SEQ ID NO: 72377 - RNA, 1701 nt, Artificial Sequence; identical to SEQ ID NO: 70876
  derived and/or modified sequence opt1 from hemagglutinin__InfluenzaA__AHL95188

SEQ ID NO: 72378 - RNA, 1701 nt, Artificial Sequence; identical to SEQ ID NO: 71002
  derived and/or modified sequence opt1 from hemagglutinin__InfluenzaA__AHL95200

SEQ ID NO: 72379 - RNA, 1701 nt, Artificial Sequence; identical to SEQ ID NO: 70876
  derived and/or modified sequence opt1 from hemagglutinin__InfluenzaA__AHL95212

SEQ ID NO: 72380 - RNA, 1701 nt, Artificial Sequence; identical to SEQ ID NO: 70866
  derived and/or modified sequence opt1 from hemagglutinin__InfluenzaA__AHL95224

SEQ ID NO: 72381 - RNA, 1701 nt, Artificial Sequence; identical to SEQ ID NO: 70866
  derived and/or modified sequence opt1 from hemagglutinin__InfluenzaA__AHL95236

SEQ ID NO: 72382 - RNA, 1701 nt, Artificial Sequence; identical to SEQ ID NO: 70891
  derived and/or modified sequence opt1 from hemagglutinin__InfluenzaA__AHL95248

SEQ ID NO: 72383 - RNA, 1701 nt, Artificial Sequence
  derived and/or modified sequence opt1 from hemagglutinin__InfluenzaA__AHL95260
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucagcgagaucugcgacagcccccaccagauccucgacggggagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacaacgagagcuucaacugggccggcgugacgcagaacgggaccuccagcgccugcauccggggcuccaacagcuccuucuucagccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcgggcggaucaccgugagcaccaagcgcucccagcaggccgugaucccgaacaucggcagccggccccgcauccggaacauccccucccgcaucagcaucuacuggaccaucgucaagcccggcgacauccugcucaucaacuccacggggaaccugaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucaccuacggggcgugcccccgguacgugaagcagagcacccugaagcucgccacgggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccugaaguccacccaggccgccaucgaccagaucaacgggaagcugaaccgccucaucggcaagaccaacgagaaguuccaccagaucgagaaggaguucuccgagguggagggccggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccgcaacggcacguacgaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggcgugccagaaggggaacauccggugcaacaucugcaucuga

SEQ ID NO: 72384 - RNA, 1701 nt, Artificial Sequence; identical to SEQ ID NO: 70876
  derived and/or modified sequence opt1 from hemagglutinin__InfluenzaA__AHL95272

SEQ ID NO: 72385 - RNA, 1701 nt, Artificial Sequence; identical to SEQ ID NO: 71002
  derived and/or modified sequence opt1 from hemagglutinin__InfluenzaA__AHL95284

SEQ ID NO: 72386 - RNA, 1701 nt, Artificial Sequence
  derived and/or modified sequence opt1 from hemagglutinin__InfluenzaA__AHL95296
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagcaaguacuccaagaaguucaagcccgagaucgccauccggccgaagguccgcgaccaggagggccggaugaacuacuacuggacccugaucgagcccggggacaagaucaccuucgaggcgacgggcaaccucguggugccccgcuacgccuucgccauggagcggaacgccgggagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcgccucgcgacgggccugcggaacgugccgagcauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaaggacaacgccaaggagaucgggaacggcugcuucgaguucuaccacaagugcgacaacacgugcauggagagcgucaagaacgggaccuacgacuaccccaaguacuccgaggaggccaagcugaaccgcgagaagaucgacggcgugaagcucgagagcacccggaucuaccagauccuggcgaucuacuccaccguggccagcucccugguccucguggugagccugggggccaucagcuucuggaugugcuccaacggcagccugcagugccgcaucugcaucuga

SEQ ID NO: 72387 - RNA, 1701 nt, Artificial Sequence; identical to SEQ ID NO: 70843
  derived and/or modified sequence opt1 from hemagglutinin__InfluenzaA__AHL95307

SEQ ID NO: 72388 - RNA, 1701 nt, Artificial Sequence; identical to SEQ ID NO: 70866
  derived and/or modified sequence opt1 from hemagglutinin__InfluenzaA__AHL95319

SEQ ID NO: 72389 - RNA, 1701 nt, Artificial Sequence
  derived and/or modified sequence opt1 from hemagglutinin__InfluenzaA__AHL95331
augaagaccaucaucgcccugagcuacauccucugccugguguucgcccagaagcugcccggcgacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 72390 - RNA, 1701 nt, Artificial Sequence
  derived and/or modified sequence opt1 from hemagglutinin__InfluenzaA__AHL95343
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagauccggggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 72391 - RNA, 1701 nt, Artificial Sequence; identical to SEQ ID NO: 70866
  derived and/or modified sequence opt1 from hemagglutinin__InfluenzaA__AHL95432

SEQ ID NO: 72392 - RNA, 1701 nt, Artificial Sequence; identical to SEQ ID NO: 71002
  derived and/or modified sequence opt1 from hemagglutinin__InfluenzaA__AHL95444

SEQ ID NO: 72393 - RNA, 1701 nt, Artificial Sequence; identical to SEQ ID NO: 70866
  derived and/or modified sequence opt1 from hemagglutinin__InfluenzaA__AHL95457

SEQ ID NO: 72394 - RNA, 1701 nt, Artificial Sequence
  derived and/or modified sequence opt1 from hemagglutinin__InfluenzaA__AHL95470
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugaagcagaacggcaccuccagcgccugcauccgccgguccaacagcuccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccgugagcaccaagcgcucccagcaggccgugaucccgaacaucggcagccggccccgcauccggaacauccccucccgcaucagcaucuacuggacgaucguccggcccggcgacauccugcucaucaacuccaccgggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacccaggcggccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacaaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 72395 - RNA, 1701 nt, Artificial Sequence; identical to SEQ ID NO: 71002
  derived and/or modified sequence opt1 from hemagglutinin__InfluenzaA__AHL95482

SEQ ID NO: 72396 - RNA, 1701 nt, Artificial Sequence; identical to SEQ ID NO: 71002
  derived and/or modified sequence opt1 from hemagglutinin__InfluenzaA__AHL95494

SEQ ID NO: 72397 - RNA, 1701 nt, Artificial Sequence
  derived and/or modified sequence opt1 from hemagglutinin__InfluenzaA__AHL95506
augaagaccaucaucgcccugagcuacauccucugccugguguucgcccagaagcugcccggcaacgacaacuccaccgcgacgcucugccuggggcaccacgccgucccgaacggcaccaucgugcgcaccaucaccaacgaccggaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacugggccggggugacgcagaacggcaccagcuccgccugcauccgcgggagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggagccagcaggccgugaucccgaacaucggcucccgcccccggauccgcaacauccccagccggaucuccaucuacuggaccaucgucaagcccggggacauccugcucaucaacagcacgggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 72398 - RNA, 1701 nt, Artificial Sequence
  derived and/or modified sequence opt1 from hemagglutinin__InfluenzaA__AHL95518
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacguccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgucaagcaguccacccugaagcucgccacggggaugcgcaacgugcccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 72399 - RNA, 1701 nt, Artificial Sequence; identical to SEQ ID NO: 70876
  derived and/or modified sequence opt1 from hemagglutinin__InfluenzaA__AHL95530

SEQ ID NO: 72400 - RNA, 1701 nt, Artificial Sequence; identical to SEQ ID NO: 70876
  derived and/or modified sequence opt1 from hemagglutinin__InfluenzaA__AHL95542

SEQ ID NO: 72401 - RNA, 1701 nt, Artificial Sequence
  derived and/or modified sequence opt1 from hemagglutinin__InfluenzaA__AHL95554
augaagaccaucaucgcccugagcuacauccucugccugguguucgcccagaagcugcccggcaacgacaacuccauggcgacccucugccuggggcaccacgccgucccgaacggcacgaucgugaagaccaucaccaacgaccgcaucgaggugaccaacgccacggagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggaccggggugacgcagaacggcaccagcuccgccugcauccggcgcagcaacuccagcuucuucucccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggaccaucgucaagcccggcgacauccugcucaucaacagcacggggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacccugaagcucgcgacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72402 - RNA, 1701 nt, Artificial Sequence
  derived and/or modified sequence opt1 from hemagglutinin__InfluenzaA__AHL95566
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccggagcuccggccgcaucaccgugagcaccaagcggagccagcaggccgugaucccgaacaucggcucccgcccccggauccgcaacauccccagccggaucuccaucuacuggaccaucgucaagcccggggacauccugcucaucaacagcacgggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 72403 - RNA, 1701 nt, Artificial Sequence
  derived and/or modified sequence opt1 from hemagglutinin__InfluenzaA__AHL95578
augaagaccaucaucgcccugagcuacauccucugccugguguucgcccagaagcugcccggcaacgacgacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 72404 - RNA, 1701 nt, Artificial Sequence
  derived and/or modified sequence opt1 from hemagglutinin__InfluenzaA__AHL95590
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccagcugcauccggcgcuccaacagcuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcccaguccagcgggcgcaucaccgugagcaccaagcggucccagcaggcggugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgccaccggcaugcggaacguccccgagaagcagacccgcgggaucuucggcgcgaucgccggguucaucgagaacggcugggagggcaugguggacgggugguacggcuuccggcaccagaacuccgaggggcgcggccaggccgccgaccucaagagcacccaggccgcgaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacaacguguaccgcgacgaggcgcucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 72405 - RNA, 1701 nt, Artificial Sequence; identical to SEQ ID NO: 70876
  derived and/or modified sequence opt1 from hemagglutinin__InfluenzaA__AHL95602

SEQ ID NO: 72406 - RNA, 1701 nt, Artificial Sequence; identical to SEQ ID NO: 70876
  derived and/or modified sequence opt1 from hemagglutinin__InfluenzaA__AHL95614

SEQ ID NO: 72407 - RNA, 1701 nt, Artificial Sequence
  derived and/or modified sequence opt1 from hemagglutinin__InfluenzaA__AHL95626
augaagaccaucaucgcccugagcuacgugcucugccuggucuucgcccagaagcugcccggcaacgacaacuccaccgcgacgcucugccuggggcaccacgccgugccgaacggcaccaucgugaagaccaucaccaacgaccgcaucgaggucacgaacgccaccgagcuggugcagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcagccucguggccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgucaccaugcccaacaacgagcaguucgacaagcucuacaucuggggcgugcaccaccccgggacggacaaggaccagaucuuccuguacgcccagagcuccggccggaucaccgugagcaccaagcgcagccagcaggccgucaucccgaacaucggcucccggccccgcauccggaacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgucaagcaguccacccugaagcucgccacggggaugcgcaacgugcccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 72408 - RNA, 1701 nt, Artificial Sequence; identical to SEQ ID NO: 70876
  derived and/or modified sequence opt1 from hemagglutinin__InfluenzaA__AHL95638

SEQ ID NO: 72409 - RNA, 1701 nt, Artificial Sequence; identical to SEQ ID NO: 70876
  derived and/or modified sequence opt1 from hemagglutinin__InfluenzaA__AHL95650

SEQ ID NO: 72410 - RNA, 1701 nt, Artificial Sequence
  derived and/or modified sequence opt1 from hemagglutinin__InfluenzaA__AHL95662
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucacccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 72411 - RNA, 1701 nt, Artificial Sequence; identical to SEQ ID NO: 71002
  derived and/or modified sequence opt1 from hemagglutinin__InfluenzaA__AHL95686

SEQ ID NO: 72412 - RNA, 1701 nt, Artificial Sequence; identical to SEQ ID NO: 71002
  derived and/or modified sequence opt1 from hemagglutinin__InfluenzaA__AHL95698

SEQ ID NO: 72413 - RNA, 1701 nt, Artificial Sequence; identical to SEQ ID NO: 70876
  derived and/or modified sequence opt1 from hemagglutinin__InfluenzaA__AHL95710

SEQ ID NO: 72414 - RNA, 1701 nt, Artificial Sequence; identical to SEQ ID NO: 72390
  derived and/or modified sequence opt1 from hemagglutinin__InfluenzaA__AHL95722

SEQ ID NO: 72415 - RNA, 1701 nt, Artificial Sequence; identical to SEQ ID NO: 70866
  derived and/or modified sequence opt1 from hemagglutinin__InfluenzaA__AHL95734

SEQ ID NO: 72416 - RNA, 1701 nt, Artificial Sequence; identical to SEQ ID NO: 70866
  derived and/or modified sequence opt1 from hemagglutinin__InfluenzaA__AHL95746

SEQ ID NO: 72417 - RNA, 1701 nt, Artificial Sequence; identical to SEQ ID NO: 71005
  derived and/or modified sequence opt1 from hemagglutinin__InfluenzaA__AHL95758

SEQ ID NO: 72418 - RNA, 1701 nt, Artificial Sequence; identical to SEQ ID NO: 70876
  derived and/or modified sequence opt1 from hemagglutinin__InfluenzaA__AHL95770

SEQ ID NO: 72419 - RNA, 1701 nt, Artificial Sequence
  derived and/or modified sequence opt1 from hemagglutinin__InfluenzaA__AHL95782
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72420 - RNA, 1701 nt, Artificial Sequence
  derived and/or modified sequence opt1 from hemagglutinin__InfluenzaA__AHL95794
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcggaacaaggccuacuccaacugcuaccccuacgacgugccggacuacgcgagccugcgcucccucgucgccagcuccggcacccuggaguucaacaacgagagcuucaacugggccggggugacgcagaacggcaccuccagcgccugcauccggggguccaacagcuccuucuucagccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccggaucaccguguccaccaagcgcagccagcaggccgugaucccgaacaucggcagccggccccgcauccggaacauccccucccgcaucagcaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcucgccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 72421 - RNA, 1701 nt, Artificial Sequence
  derived and/or modified sequence opt1 from hemagglutinin__InfluenzaA__AHL95806
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucgggagcaucaugugggcgugccagaagggcaacauccggugcaacaucugcaucuga

SEQ ID NO: 72422 - RNA, 1701 nt, Artificial Sequence; identical to SEQ ID NO: 71002
  derived and/or modified sequence opt1 from hemagglutinin__InfluenzaA__AHL95818

SEQ ID NO: 72423 - RNA, 1701 nt, Artificial Sequence; identical to SEQ ID NO: 70866
  derived and/or modified sequence opt1 from hemagglutinin__InfluenzaA__AHL95830

SEQ ID NO: 72424 - RNA, 1701 nt, Artificial Sequence; identical to SEQ ID NO: 71002
  derived and/or modified sequence opt1 from hemagglutinin__InfluenzaA__AHL95842

SEQ ID NO: 72425 - RNA, 1701 nt, Artificial Sequence; identical to SEQ ID NO: 70866
  derived and/or modified sequence opt1 from hemagglutinin__InfluenzaA__AHL95854

SEQ ID NO: 72426 - RNA, 1701 nt, Artificial Sequence; identical to SEQ ID NO: 70876
  derived and/or modified sequence opt1 from hemagglutinin__InfluenzaA__AHL95866

SEQ ID NO: 72427 - RNA, 1701 nt, Artificial Sequence
  derived and/or modified sequence opt1 from hemagglutinin__InfluenzaA__AHL95878
augaaggccauccuggugaucaugcucuacaccuucgccaccgcgaacgccgacacgcugugcaucggcuaccacgccaacaacagcaccgacaccgucgacaccgugcuggagaagaacgugacggucacccacuccgugaaccuccuggaggacaagcacaacgggaagcugugcaagcuccgcggcgugagcccccugcaccuggggaagugcaacaucgccggcuggauccucgggaacccggagugcgagucccugagcaccgccuccagcugguccuacaucgucgagaccagcggcuccgacaacggcacgugcuaccccggggacuucaucgacuacgaggagcugcgggagcagcucagcuccgugagcuccuucgagcgcuucgagaucuuccccaagaccagcuccuggcccaaccacgacagcaacaagggcgugaccgcggccugcccgcacgccggggccaagggcuucuacaagaaccugaucuggcuggucaagaaggggaacuccuaccccaagcucagcaucuccuacaucaacgacaagggcaaggaggugcuggugcuguggggcauccaccaccccagcaccacggcggaccagcagagccucuaccagaacgccgacaccuacgucuucguggggaccucccgguacagcaagaaguucaagcccgagaucgccauccgcccgaaggugcgggaccaggagggccgcaugaacuacuacuggacccuggucgagcccggggacaagaucacguucgaggccaccggcaaccugguggugccccgguacgccuucgcgauggagcgcaacgccggcuccgggaucaucaucagcgacacccccguccacgacugcaacaccacgugccagaccccgaagggcgccaucaacaccucccuccccuuccagaacauccaccccaucaccaucgggaagugccccaaguacgucaagagcacgaagcugcggcuggccaccggccuccgcaacgugccguccauccagagccgggggcuguucggcgccaucgcgggcuucaucgagggcggguggaccgggaugguggacggcugguacggguaccaccaccagaacgagcagggcuccggcuacgccgccgaccucaagagcacccagaacgccaucgacaagaucacgaacaaggugaacuccgugaucgagaagaugaacacccaguucaccgccgucgggaaggaguucaaccaccuggagaagcgcaucgagaaccugaacaagaagguggacgacggcuuccuggacaucuggaccuacaacgcggagcuccugguccugcucgagaacgagcggacgcuggacuaccacgacagcaacgugaagaaccuguacgagaaggugcgcaaccagcucaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcuggaguccacccgcaucuaccagauccucgccaucuacagcaccgccgcguccagccuggugcuggucgugucccucggcgccaucagcuucuggaugugcagcaacgggucccugcagugccggaucugcaucuga

SEQ ID NO: 72428 - RNA, 1701 nt, Artificial Sequence; identical to SEQ ID NO: 70876
  derived and/or modified sequence opt1 from hemagglutinin__InfluenzaA__AHL95889

SEQ ID NO: 72429 - RNA, 1701 nt, Artificial Sequence; identical to SEQ ID NO: 71002
  derived and/or modified sequence opt1 from hemagglutinin__InfluenzaA__AHL95901

SEQ ID NO: 72430 - RNA, 1701 nt, Artificial Sequence; identical to SEQ ID NO: 71002
  derived and/or modified sequence opt1 from hemagglutinin__InfluenzaA__AHL95913

SEQ ID NO: 72431 - RNA, 1701 nt, Artificial Sequence
  derived and/or modified sequence opt1 from hemagglutinin__InfluenzaA__AHL95937
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaccgaccugugguccuacaacgccgagcuccugguggcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 72432 - RNA, 1701 nt, Artificial Sequence
  derived and/or modified sequence opt1 from hemagglutinin__InfluenzaA__AHL95949
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccacuccaacuucaaguaccccgcccugaacaugacgaugcccaacaacgagcaguucgacaagcuguacaucuggggcgugcaccaccccgggaccgacaaggaccagaucuuccucuacgcgcagagcuccgggcgcaucaccgucagcaccaagcggagccagcaggccgugaucccgaacaucggcucccgcccccggauccgcaacauccccagccggaucuccaucuacuggacgaucgugaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgucaaccggaucaccuacggggccugcccccgcuacgugaagcaguccacgcugaagcuggcgaccggcaugcggaacgugcccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 72433 - RNA, 1701 nt, Artificial Sequence; identical to SEQ ID NO: 70876
  derived and/or modified sequence opt1 from hemagglutinin__InfluenzaA__AHL95961

SEQ ID NO: 72434 - RNA, 1701 nt, Artificial Sequence; identical to SEQ ID NO: 70876
  derived and/or modified sequence opt1 from hemagglutinin__InfluenzaA__AHL95973

SEQ ID NO: 72435 - RNA, 1701 nt, Artificial Sequence; identical to SEQ ID NO: 70876
  derived and/or modified sequence opt1 from hemagglutinin__InfluenzaA__AHL95985

SEQ ID NO: 72436 - RNA, 1701 nt, Artificial Sequence
  derived and/or modified sequence opt1 from hemagglutinin__InfluenzaA__AHL95997
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaagagcuccuucuucagccgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcaguccagcggccggaucaccgugagcaccaagcgcucccagcaggccgugaucccgaacaucggcagccggccccgcauccggaacauccccucccgcaucagcaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgccugcccccgguacgugaagcagagcacccugaagcucgcgacggggaugcgcaacguccccgagaagcagacccggggcaucuucggggccaucgccggcuucaucgagaacggcugggaggggaugauggacggcugguacggguuccgccaccagaacuccgagggccgggggcaggccgccgaccucaagagcacccaggcggccaucgaccagaucaacggcaagcugaaccgccugaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 72437 - RNA, 1701 nt, Artificial Sequence
  derived and/or modified sequence opt1 from hemagglutinin__InfluenzaA__AHL96021
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaaguccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 72438 - RNA, 1701 nt, Artificial Sequence; identical to SEQ ID NO: 70876
  derived and/or modified sequence opt1 from hemagglutinin__InfluenzaA__AHL96033

SEQ ID NO: 72439 - RNA, 1701 nt, Artificial Sequence; identical to SEQ ID NO: 71131
  derived and/or modified sequence opt1 from hemagglutinin__InfluenzaA__AHL96045

SEQ ID NO: 72440 - RNA, 1701 nt, Artificial Sequence; identical to SEQ ID NO: 71002
  derived and/or modified sequence opt1 from hemagglutinin__InfluenzaA__AHL96056

SEQ ID NO: 72441 - RNA, 1701 nt, Artificial Sequence; identical to SEQ ID NO: 70866
  derived and/or modified sequence opt1 from hemagglutinin__InfluenzaA__AHL96068

SEQ ID NO: 72442 - RNA, 1701 nt, Artificial Sequence; identical to SEQ ID NO: 70876
  derived and/or modified sequence opt1 from hemagglutinin__InfluenzaA__AHL96080

SEQ ID NO: 72443 - RNA, 1701 nt, Artificial Sequence
  derived and/or modified sequence opt1 from hemagglutinin__InfluenzaA__AHL96092
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucaucgagcgguccaaggccuacagcaacugcuaccccuacgacgugccggacuacgcgucccugcgcagccucguggccuccagcggcacccuggaguucaacaacgaguccuucaacugggccggggucacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcgugcaccaccccgggacggacaaggaccagaucuuccuguacgcccagagcuccggccggaucaccgucagcaccaagcgcagccagcaggccgugaucccgaacaucggcucccggccccgcauccggaacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgucaaccgcaucaccuacggcgcgugcccccgguacgugaagcaguccacccugaagcucgccacggggaugcgcaacgugcccgagaagcagacccggggcaucuucggggccaucgccggcuucaucgagaacggcugggaggggauggucgacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 72444 - RNA, 1701 nt, Artificial Sequence
  derived and/or modified sequence opt1 from hemagglutinin__InfluenzaA__AHL96104
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagcgccagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 72445 - RNA, 1701 nt, Artificial Sequence; identical to SEQ ID NO: 71490
  derived and/or modified sequence opt1 from hemagglutinin__InfluenzaA__AHL96116

SEQ ID NO: 72446 - RNA, 1701 nt, Artificial Sequence; identical to SEQ ID NO: 70866
  derived and/or modified sequence opt1 from hemagglutinin__InfluenzaA__AHL96128

SEQ ID NO: 72447 - RNA, 1701 nt, Artificial Sequence; identical to SEQ ID NO: 71002
  derived and/or modified sequence opt1 from hemagglutinin__InfluenzaA__AHL96152

SEQ ID NO: 72448 - RNA, 1701 nt, Artificial Sequence
  derived and/or modified sequence opt1 from hemagglutinin__InfluenzaA__AHL96164
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaagaacuggauccuguggaucuccuucgccaucagcugcuuccugcugugcguggcccugcucggguucaucaugugggcgugccagaagggcaacauccggugcaacaucugcaucuga

SEQ ID NO: 72449 - RNA, 1701 nt, Artificial Sequence; identical to SEQ ID NO: 71002
  derived and/or modified sequence opt1 from hemagglutinin__InfluenzaA__AHL96176

SEQ ID NO: 72450 - RNA, 1701 nt, Artificial Sequence; identical to SEQ ID NO: 71002
  derived and/or modified sequence opt1 from hemagglutinin__InfluenzaA__AHL96188

SEQ ID NO: 72451 - RNA, 1701 nt, Artificial Sequence
  derived and/or modified sequence opt1 from hemagglutinin__InfluenzaA__AHL96200
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccaggugcucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcagccucguggccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgucaccaugcccaacaacgagcaguucgacaagcucuacaucuggggcgugcaccaccccgggacggacaaggaccagaucuuccuguacgcccagagcuccggccggaucaccgugagcaccaagcgcagccagcaggccgucaucccgaacaucggcucccggccccgcauccggaacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgucaagcaguccacccugaagcucgccacggggaugcgcaacgugcccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 72452 - RNA, 1701 nt, Artificial Sequence; identical to SEQ ID NO: 70866
  derived and/or modified sequence opt1 from hemagglutinin__InfluenzaA__AHL96212

SEQ ID NO: 72453 - RNA, 1701 nt, Artificial Sequence; identical to SEQ ID NO: 71475
  derived and/or modified sequence opt1 from hemagglutinin__InfluenzaA__AHL96224

SEQ ID NO: 72454 - RNA, 1701 nt, Artificial Sequence
  derived and/or modified sequence opt1 from hemagglutinin__InfluenzaA__AHL96236
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaugggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucgaguccauccggaacgggaccuacgaccacgacguguaccgcgacgaggcccucaacaaccgguuccagaucaagggcgucgagcucaagagcggguacaagaacuggauccuguggaucuccuucgccaucagcugcuuccugcugugcguggcccugcucggcuucaucaugugggccugccagaagggcaacauccgcugcaacaucugcaucuga

SEQ ID NO: 72455 - RNA, 1701 nt, Artificial Sequence
  derived and/or modified sequence opt1 from hemagglutinin__InfluenzaA__AHL96248
augaagaccaucaucgcccugggcuacauccucugccugguguucgcccagaagcugcccgggaacgacaacagcaccgcgacgcucugccugggccaccacgccgucccgaacgggaccaucgugaagaccaucaccaacgaccgcaucgaggugacgaacgccaccgagcugguccagaacuccagcaucggcgagaucugcgacagcccccaccagauccucgacggggagaacugcacccugaucgacgcccugcucggcgacccccagugcgacggcuuccagaacaagaagugggaccuguucaucgagcggagcaaggccuacuccaacugcuaccccuacgacgugccggacuacgcgagccugcgcucccucguggccagcuccgggacccuggaguucaacaacgagagcuucaacuggacgggcgucacccagaacgggaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcgugcaccaccccgggaccgacaaggaccagaucuuccuguacgcgcaguccagcggccgcaucaccgucuccaccaagcggagccagcaggccgugaucccgaacaucggcagccgcccccggauccgcaacauccccucccggaucagcaucuacuggacgaucgugaagcccggggacauccugcucaucaacuccaccggcaaccugaucgccccgcgcggguacuucaagauccggagcggcaaguccagcaucaugcgcuccgacgcccccaucggcaagugcaagagcgagugcaucacccccaacggguccauccccaacgacaagccguuccagaacgucaaccggaucaccuacggcgccugcccccgcuacgugaagcagagcacgcugaagcucgcgaccgggaugcggaacgugcccgagaagcagacccgcggcaucuucggggccaucgccggcuucaucgagaacggcugggaggggauggucgacggcugguacggguuccggcaccagaacuccgagggccgcgggcaggccgccgaccugaaguccacccaggcggccaucgaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcagcauccggaacgggaccuacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 72456 - RNA, 1701 nt, Artificial Sequence; identical to SEQ ID NO: 71002
  derived and/or modified sequence opt1 from hemagglutinin__InfluenzaA__AHL96260

SEQ ID NO: 72457 - RNA, 1701 nt, Artificial Sequence; identical to SEQ ID NO: 70866
  derived and/or modified sequence opt1 from hemagglutinin__InfluenzaA__AHL96274

SEQ ID NO: 72458 - RNA, 1701 nt, Artificial Sequence; identical to SEQ ID NO: 71002
  derived and/or modified sequence opt1 from hemagglutinin__InfluenzaA__AHL96304

SEQ ID NO: 72459 - RNA, 1701 nt, Artificial Sequence; identical to SEQ ID NO: 70843
  derived and/or modified sequence opt1 from hemagglutinin__InfluenzaA__AHL96318

SEQ ID NO: 72460 - RNA, 1701 nt, Artificial Sequence; identical to SEQ ID NO: 71002
  derived and/or modified sequence opt1 from hemagglutinin__InfluenzaA__AHL96330

SEQ ID NO: 72461 - RNA, 1701 nt, Artificial Sequence; identical to SEQ ID NO: 71005
  derived and/or modified sequence opt1 from hemagglutinin__InfluenzaA__AHL96342

SEQ ID NO: 72462 - RNA, 1701 nt, Artificial Sequence
  derived and/or modified sequence opt1 from hemagglutinin__InfluenzaA__AHL96354
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccugaacagcgagggccgggggcaggccgcggaccugaaguccacccaggccgccaucgaccagaucaacggcaagcucaaccgccugaucggcaagaccaacgagaaguuccaccagaucgagaaggaguucagcgagguggaggggcggauccaggaccuggagaaguacgucgaggacacgaagaucgaccucugguccuacaacgccgagcugcugguggcccucgagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcugugcguggcccuccugggguucaucaugugggcgugccagaagggcaacauccggugcaacaucugcaucuga

SEQ ID NO: 72463 - RNA, 1701 nt, Artificial Sequence
  derived and/or modified sequence opt1 from hemagglutinin__InfluenzaA__AHL96366
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccgcaucgaggugacgaacgccaccgagcugguccagaacagcuccaucggcgagaucugcgacagcccccaccagauccucgacggggagaacugcacccugaucgacgcccugcucggcgacccccagugcgacggguuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggcgugacgcagaacgggaccagcuccgccugcauccggggcagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcggaucaccgugagcaccaagcgcagccagcaggccgugaucccgaacaucggcucccggccccgcauccggaacauccccagccgcaucuccaucuacuggaccaucgucaagcccggcgacauccugcucaucaacagcacggggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggcgugcccccgguacgugaagcaguccacccugaagcucgccacgggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 72464 - RNA, 1701 nt, Artificial Sequence; identical to SEQ ID NO: 70876
  derived and/or modified sequence opt1 from hemagglutinin__InfluenzaA__AHL96378

SEQ ID NO: 72465 - RNA, 1701 nt, Artificial Sequence; identical to SEQ ID NO: 70866
  derived and/or modified sequence opt1 from hemagglutinin__InfluenzaA__AHL96390

SEQ ID NO: 72466 - RNA, 1701 nt, Artificial Sequence
  derived and/or modified sequence opt1 from hemagglutinin__InfluenzaA__AHL96402
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgggggagcaacuccagcuucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccggccggaucaccgugagcaccaagcgcagccagcaggccgugaucccgaacaucggcucccggccccgcauccggaacauccccagccgcaucuccaucuacuggacgaucgucaagcccggggacauccugcugaucaacagcaccggcaaccucaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacgcugaagcuggcgaccgggaugcgcaacguccccgagaagcagacccggggcaucuucggggccaucgccggcuucaucgagaacggcugggaggggaugguggacggcugguacggguuccgccaccagaacagcgagggccgggggcaggccgccgaccucaaguccacccaggcggccaucgaccagaucaacggcaagcugaaccgccugaucggcaagacgaacaagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggccugccagaagggcaacauccggugcaacaucugcaucuga

SEQ ID NO: 72467 - RNA, 1701 nt, Artificial Sequence; identical to SEQ ID NO: 70876
  derived and/or modified sequence opt1 from hemagglutinin__InfluenzaA__AHL96414

SEQ ID NO: 72468 - RNA, 1701 nt, Artificial Sequence; identical to SEQ ID NO: 71002
  derived and/or modified sequence opt1 from hemagglutinin__InfluenzaA__AHL96426

SEQ ID NO: 72469 - RNA, 1701 nt, Artificial Sequence
  derived and/or modified sequence opt1 from hemagglutinin__InfluenzaA__AHL96438
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcagcuccgcgugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 72470 - RNA, 1701 nt, Artificial Sequence; identical to SEQ ID NO: 70876
  derived and/or modified sequence opt1 from hemagglutinin__InfluenzaA__AHL96450

SEQ ID NO: 72471 - RNA, 1701 nt, Artificial Sequence; identical to SEQ ID NO: 71002
  derived and/or modified sequence opt1 from hemagglutinin__InfluenzaA__AHL96462

SEQ ID NO: 72472 - RNA, 1701 nt, Artificial Sequence
  derived and/or modified sequence opt1 from hemagglutinin__InfluenzaA__AHL96474
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucagcccccugcaccuggggaagugcaacaucgccggcuggauccucgggaacccggagugcgagucccugagcaccgccuccagcugguccuacaucguggagaccagcggcuccgacaacggcacgugcuaccccggggacuucaucgacuacgaggagcugcgggagcagcucagcuccgugagcuccuucgagcgcuucgagaucuuccccaagaccagcuccuggcccaaccacgacagcaacaagggcgucaccgcggccugcccgcacgccggggccaagggcuucuacaagaaccugaucuggcuggugaagaaggggaacuccuaccccaagcucagcaucuccuacaucaacgacaagggcaaggaggugcugguccuguggggcauccaccaccccagcaccacggcggaccagcagagccucuaccagaacgccgacaccuacguguucguggggaccucccgguacagcaagaaguucaagcccgagaucgccauccgcccgaagguccgggaccaggagggccgcaugaacuacuacuggacccugguggagcccggggacaagaucacguucgaggccaccggcaaccugguggucccccgguacgccuucgcgauggagcgcaacgccggcuccgggaucaucaucagcgacacccccgugcacgacugcaacaccacgugccagaccccgaagggcgccaucaacaccucccuccccuuccagaacauccaccccaucaccaucgggaagugccccaaguacgucaagagcacgaagcugcggcuggccaccggccuccgcaacgugccguccauccagagccgggggcuguucggcgccaucgcgggcuucaucgagggcggguggaccgggaugguggacggcugguacggguaccaccaccagaacgagcagggcuccggcuacgccgccgaccucaagagcacccagaacgccaucgacaagaucacgaacaaggugaacuccgucaucgagaagaugaacacccaguucaccgccguggggaaggaguucaaccaccuggagaagcgcaucgagaaccugaacaagaaggucgacgacggcuuccuggacaucuggaccuacaacgcggagcuccuggugcugcucgagaacgagcggacgcuggacuaccacgacagcaacgugaagaaccuguacgagaagguccgcaaccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgccgcguccagccugguccugguggugucccucggcgccaucagcuucuggaugugcagcaacgggucccugcagugccggaucugcaucuga

SEQ ID NO: 72473 - RNA, 1701 nt, Artificial Sequence
  derived and/or modified sequence opt1 from hemagglutinin__InfluenzaA__AHL96485
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugaaguccgacgcccccaucgggaagugcaagagcgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 72474 - RNA, 1701 nt, Artificial Sequence; identical to SEQ ID NO: 71002
  derived and/or modified sequence opt1 from hemagglutinin__InfluenzaA__AHL96497

SEQ ID NO: 72475 - RNA, 1701 nt, Artificial Sequence; identical to SEQ ID NO: 70876
  derived and/or modified sequence opt1 from hemagglutinin__InfluenzaA__AHL96509

SEQ ID NO: 72476 - RNA, 1701 nt, Artificial Sequence; identical to SEQ ID NO: 70843
  derived and/or modified sequence opt1 from hemagglutinin__InfluenzaA__AHL96521

SEQ ID NO: 72477 - RNA, 1701 nt, Artificial Sequence; identical to SEQ ID NO: 71002
  derived and/or modified sequence opt1 from hemagglutinin__InfluenzaA__AHL96533

SEQ ID NO: 72478 - RNA, 1701 nt, Artificial Sequence; identical to SEQ ID NO: 70866
  derived and/or modified sequence opt1 from hemagglutinin__InfluenzaA__AHL96545

SEQ ID NO: 72479 - RNA, 1701 nt, Artificial Sequence
  derived and/or modified sequence opt1 from hemagglutinin__InfluenzaA__AHL96569
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcgugaccgugagcaccaagcggagccagcaggccgucaucccgaacaucggcucccgcccccggauccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgucaagcaguccacgcugaagcucgcgaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72480 - RNA, 1701 nt, Artificial Sequence; identical to SEQ ID NO: 72472
  derived and/or modified sequence opt1 from hemagglutinin__InfluenzaA__AHL96581

SEQ ID NO: 72481 - RNA, 1701 nt, Artificial Sequence
  derived and/or modified sequence opt1 from hemagglutinin__InfluenzaA__AHL96592
augaagaccaucaucgcccugggcuacauccucugccugguguucgcccagaagauccccgggaacgacaacagcaccgcgacgcugugccucggccaccacgccgucccgaacgggaccaucgugaagaccaucaccaacgaccgcaucgaggugacgaacgccaccgagcugguccagaacuccagcaucggcgagaucugcgacagcccccaccagauccuggacggggagaacugcacccucaucgacgcccugcugggcgacccccagugcgacggcuuccagaacaagaagugggaccucuucaucgagcgguccaaggccuacuccaacugcuaccccuacgacgugccggacuacgcgagccugcgcucccugguggccagcuccgggacccucgaguucaacaacgagagcuucaacuggacgggcgucacccagaacgggaccuccagcgccugcauccggcgcuccaacagcuccuucuucagccggcugaacuggcugacccaccucaacuucaaguaccccgcccugaacgugacgaugcccaacaacgagcaguucgacaagcuguacaucuggggcgugcaccaccccgggaccgacaaggaccagaucuuccucuacgcgcaguccagcggccgcaucaccgucuccaccaagcggagccagcaggccgugaucccgaacaucggcagccgcccccggauccgcaacauccccucccggaucagcaucuacuggacgaucgugaagcccggggacauccugcugaucaacuccaccggcaaccucaucgccccgcgcggguacuucaagauccggagcggcaaguccagcaucaugcgcuccgacgcccccaucggcaagugcaagagcgagugcaucacccccaacggguccauccccaacgacaagccguuccagaacgucaaccggaucaccuacggcgccugcccccgcuacgugaagcagagcacgcugaagcuggcgaccgggaugcggaacgugcccgagaagcagacccgcggcaucuucggggccaucgccggcuucaucgagaacggcugggaggggauggucgacggcugguacggguuccggcaccagaacuccgagggccgcgggcaggccgccgaccucaagagcacccaggcggccaucgaccagaucaacggcaagcugaaccggcugaucggcaagacgaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcguggagcucaaguccggcuacaaggacuggauccuguggaucagcuucgccaucuccugcuuccugcucugcgucgcccugcugggguucaucaugugggccugccagaagggcaacauccgcugcaacaucugcaucuga

SEQ ID NO: 72482 - RNA, 1701 nt, Artificial Sequence; identical to SEQ ID NO: 71002
  derived and/or modified sequence opt1 from hemagglutinin__InfluenzaA__AHL96604

SEQ ID NO: 72483 - RNA, 1701 nt, Artificial Sequence; identical to SEQ ID NO: 71002
  derived and/or modified sequence opt1 from hemagglutinin__InfluenzaA__AHL96616

SEQ ID NO: 72484 - RNA, 1701 nt, Artificial Sequence
  derived and/or modified sequence opt1 from hemagglutinin__InfluenzaA__AHL96628
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcuggggcgggaugguggacggcugguacggguuccggcaccagaacagcgagggccgcgggcaggccgccgaccugaaguccacccaggcggccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacaacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 72485 - RNA, 1701 nt, Artificial Sequence; identical to SEQ ID NO: 72473
  derived and/or modified sequence opt1 from hemagglutinin__InfluenzaA__AHL96640

SEQ ID NO: 72486 - RNA, 1701 nt, Artificial Sequence
  derived and/or modified sequence opt1 from hemagglutinin__InfluenzaA__AHL96652
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccaggacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 72487 - RNA, 1701 nt, Artificial Sequence; identical to SEQ ID NO: 71475
  derived and/or modified sequence opt1 from hemagglutinin__InfluenzaA__AHL96664

SEQ ID NO: 72488 - RNA, 1701 nt, Artificial Sequence
  derived and/or modified sequence opt1 from hemagglutinin__InfluenzaA__AHL96676
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaucgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72489 - RNA, 1701 nt, Artificial Sequence; identical to SEQ ID NO: 71002
  derived and/or modified sequence opt1 from hemagglutinin__InfluenzaA__AHL96688

SEQ ID NO: 72490 - RNA, 1701 nt, Artificial Sequence; identical to SEQ ID NO: 71002
  derived and/or modified sequence opt1 from hemagglutinin__InfluenzaA__AHL96700

SEQ ID NO: 72491 - RNA, 1701 nt, Artificial Sequence; identical to SEQ ID NO: 71002
  derived and/or modified sequence opt1 from hemagglutinin__InfluenzaA__AHL96712

SEQ ID NO: 72492 - RNA, 1701 nt, Artificial Sequence; identical to SEQ ID NO: 70876
  derived and/or modified sequence opt1 from hemagglutinin__InfluenzaA__AHL96724

SEQ ID NO: 72493 - RNA, 1701 nt, Artificial Sequence; identical to SEQ ID NO: 70866
  derived and/or modified sequence opt1 from hemagglutinin__InfluenzaA__AHL96748

SEQ ID NO: 72494 - RNA, 1701 nt, Artificial Sequence; identical to SEQ ID NO: 70876
  derived and/or modified sequence opt1 from hemagglutinin__InfluenzaA__AHL96784

SEQ ID NO: 72495 - RNA, 1701 nt, Artificial Sequence
  derived and/or modified sequence opt1 from hemagglutinin__InfluenzaA__AHL96796
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucaucgagcgguccaaggccuacagcaacugcuaccccuacgacgugccggacuacgcgucccugcgcagccucguggccuccagcggcacccuggaguucaacaacgaguccuucaacuggacgggggucacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcgugcaccaccccgggaccgacaaggaccagaucuuccuguacgcgcagagcuccgggcgcaucaccgucagcaccaagcggagccagcaggccgugaucccgaacaucggcucccgcccccggauccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgucaaccggaucaccuacggggccugcccccgcuacgugaagcaguccacgcugaagcucgcgaccggcaugcggaacgugcccgagaagcagacccgcgggaucuucggcgccaucgccggguucaucgagaacggcugggagggcauggucgacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 72496 - RNA, 1701 nt, Artificial Sequence; identical to SEQ ID NO: 70866
  derived and/or modified sequence opt1 from hemagglutinin__InfluenzaA__AHL96808

SEQ ID NO: 72497 - RNA, 1701 nt, Artificial Sequence; identical to SEQ ID NO: 70866
  derived and/or modified sequence opt1 from hemagglutinin__InfluenzaA__AHL96820

SEQ ID NO: 72498 - RNA, 1701 nt, Artificial Sequence; identical to SEQ ID NO: 70876
  derived and/or modified sequence opt1 from hemagglutinin__InfluenzaA__AHL96832

SEQ ID NO: 72499 - RNA, 1701 nt, Artificial Sequence; identical to SEQ ID NO: 70876
  derived and/or modified sequence opt1 from hemagglutinin__InfluenzaA__AHL96844

SEQ ID NO: 72500 - RNA, 1701 nt, Artificial Sequence; identical to SEQ ID NO: 70876
  derived and/or modified sequence opt1 from hemagglutinin__InfluenzaA__AHL96856

SEQ ID NO: 72501 - RNA, 1701 nt, Artificial Sequence
  derived and/or modified sequence opt1 from hemagglutinin__InfluenzaA__AHL96868
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgggaacugcacccugaucgacgcccugcucggcgacccccagugcgacggcuuccagaacaagaagugggaccuguucguggagcgguccaaggccuacagcaacugcuaccccuacgacgugccggacuacgcgucccugcgcagccucgucgccuccagcgggacccuggaguucaacaacgaguccuucaacuggacgggcgugacccagaacgggaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugagcaccaagcggagccagcaggccguggucccgaacaucggcucccgcccccggauccgcaacauccccagccggaucuccaucuacuggacgaucgugaagcccggggacauccugcucaucaacagcaccggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgccugcccccgcuacgucaagcaguccacgcugaagcucgcgaccgggaugcggaacgugcccgagaagcagacccgcggcaucuucggggccaucgccggcuucaucgagaacggcugggaggggaugauggacggcugguacggguuccggcaccagaacagcgagggccgcgggcaggccgccgaccugaaguccacccaggcggccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcucaagagcggcuacaaggacuggauccuguggaucuccuucgccaugagcugcuuccugcugugcguggcccugcucggguucaucaugugggccugccagaagggcaacauccgcugcaacaucugcaucuga

SEQ ID NO: 72502 - RNA, 1701 nt, Artificial Sequence; identical to SEQ ID NO: 70866
  derived and/or modified sequence opt1 from hemagglutinin__InfluenzaA__AHL96880

SEQ ID NO: 72503 - RNA, 1701 nt, Artificial Sequence
  derived and/or modified sequence opt1 from hemagglutinin__InfluenzaA__AHL96892
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggguccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 72504 - RNA, 1701 nt, Artificial Sequence
  derived and/or modified sequence opt1 from hemagglutinin__InfluenzaA__AHL96904
augaagaccaucaucgcccugagcuacauccucugccugguguucgcccagaagcugcccggcaacgacaacuccaccgcgacgcucugccuggggcaccacgccgucccgaacggcaugaucgugaagaccaucaccaacgaccgcaucgaggugaccaacgccacggagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggaccggggugacgcagaacggcaccagcuccgccugcauccggcgcagcaacuccagcuucuucucccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagagcuccgggcgcaucaccgugagcaccaagcggagccagcaggccguggucccgaacaucggcucccgcccccggauccgcaacauccccagccggaucuccaucuacuggaccaucgugaagcccggcgacauccugcucaucaacagcacggggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgucaagcaguccacccugaagcucgcgacgggcaugcggaacgugcccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgguuccagaucaaggggguggagcucaagagcggcuacaaggacuggauccuguggaucuccuucgccaugagcugcuuccugcugugcguggcccugcucggcagcaucaugugggccugccagaaggggaacauccgcugcaacaucugcaucuga

SEQ ID NO: 72505 - RNA, 1701 nt, Artificial Sequence; identical to SEQ ID NO: 70866
  derived and/or modified sequence opt1 from hemagglutinin__InfluenzaA__AHL96916

SEQ ID NO: 72506 - RNA, 1701 nt, Artificial Sequence; identical to SEQ ID NO: 70866
  derived and/or modified sequence opt1 from hemagglutinin__InfluenzaA__AHL96928

SEQ ID NO: 72507 - RNA, 1701 nt, Artificial Sequence; identical to SEQ ID NO: 70866
  derived and/or modified sequence opt1 from hemagglutinin__InfluenzaA__AHL96940

SEQ ID NO: 72508 - RNA, 1701 nt, Artificial Sequence; identical to SEQ ID NO: 70876
  derived and/or modified sequence opt1 from hemagglutinin__InfluenzaA__AHL96952

SEQ ID NO: 72509 - RNA, 1701 nt, Artificial Sequence; identical to SEQ ID NO: 70876
  derived and/or modified sequence opt1 from hemagglutinin__InfluenzaA__AHL96964

SEQ ID NO: 72510 - RNA, 1701 nt, Artificial Sequence; identical to SEQ ID NO: 71034
  derived and/or modified sequence opt1 from hemagglutinin__InfluenzaA__AHL96976

SEQ ID NO: 72511 - RNA, 1701 nt, Artificial Sequence
  derived and/or modified sequence opt1 from hemagglutinin__InfluenzaA__AHL96988
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucguccgccccggcgacauccugcucaucaacagcaccgggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 72512 - RNA, 1701 nt, Artificial Sequence; identical to SEQ ID NO: 70876
  derived and/or modified sequence opt1 from hemagglutinin__InfluenzaA__AHL97000

SEQ ID NO: 72513 - RNA, 1701 nt, Artificial Sequence; identical to SEQ ID NO: 71002
  derived and/or modified sequence opt1 from hemagglutinin__InfluenzaA__AHL97012

SEQ ID NO: 72514 - RNA, 1701 nt, Artificial Sequence
  derived and/or modified sequence opt1 from hemagglutinin__InfluenzaA__AHL97024
augaagaccaucaucgcccugagcuacauccucugccugguguucgcccagaagcugcccggcaacgacaacuccaccgcgacgcucugccuggggcaccacgccgucccgaacggcaccaucgugaagaccaucaugaacgaccgcaucgaggugaccaacgccacggagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacccagaacggcacgagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggaccgacaaggaccagaucuuccuguacgcccagagcuccggccggaucacggugagcaccaagcgcagccagcaggccgugaucccgaacaucggcucccggccccgcauccggaacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaaguccgagugcaucacgcccaacgggagcauccccaacgacaagccguuccagaacgugaaccgcaucaccuacggcgcgugcccccgguacgugaagcaguccacccugaagcucgccaccgggaugcgcaacguccccgagaagcagacgcggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 72515 - RNA, 1701 nt, Artificial Sequence
  derived and/or modified sequence opt1 from hemagglutinin__InfluenzaA__AHL97036
augaagaccaucaucgcccugagcuacauccucugccugguguucgcccagaagcugcccggcaacgacaacuccaccgcgacccucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacacgugcaucggguccauccggaacggcaccuacgaccacgacguguaccgcgacgaggcgcucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72516 - RNA, 1701 nt, Artificial Sequence; identical to SEQ ID NO: 70891
  derived and/or modified sequence opt1 from hemagglutinin__InfluenzaA__AHL97048

SEQ ID NO: 72517 - RNA, 1701 nt, Artificial Sequence
  derived and/or modified sequence opt1 from hemagglutinin__InfluenzaA__AHL97060
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcaacuccagcuucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgagcacgacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 72518 - RNA, 1701 nt, Artificial Sequence; identical to SEQ ID NO: 71002
  derived and/or modified sequence opt1 from hemagglutinin__InfluenzaA__AHL97072

SEQ ID NO: 72519 - RNA, 1701 nt, Artificial Sequence; identical to SEQ ID NO: 71002
  derived and/or modified sequence opt1 from hemagglutinin__InfluenzaA__AHL97084

SEQ ID NO: 72520 - RNA, 1701 nt, Artificial Sequence; identical to SEQ ID NO: 70843
  derived and/or modified sequence opt1 from hemagglutinin__InfluenzaA__AHL97096

SEQ ID NO: 72521 - RNA, 1701 nt, Artificial Sequence; identical to SEQ ID NO: 71005
  derived and/or modified sequence opt1 from hemagglutinin__InfluenzaA__AHL97108

SEQ ID NO: 72522 - RNA, 1701 nt, Artificial Sequence
  derived and/or modified sequence opt1 from hemagglutinin__InfluenzaA__AHL97120
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcgugaccuacggcgcgugcccccgguacgucaagcaguccacccugaagcucgccacggggaugcgcaacgugcccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccaucaucaacgggacguacgaccacgacgucuaccgcgacgaggcccucaacaaccgguuccagaucaagggcguggagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 72523 - RNA, 1701 nt, Artificial Sequence
  derived and/or modified sequence opt1 from hemagglutinin__InfluenzaA__AHL97132
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacugggccggggugacgcagaacggcaccagcuccgccugcauccgcgggagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggagccagcaggccgugaucccgaacaucggcucccgcccccggauccgcaacauccccagccggaucuccaucuacuggaccaucgucaagcccggggacauccugcucaucaacagcacgggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccggcaagcagacccgcgggaucuucggcgccaucgccggcuucaucgagaacgggugggagggcaugguggacgggugguacggcuuccggcaccagaacagcgaggggcgcggccaggccgcggaccugaaguccacccaggccgccaucgaccagaucaacggcaagcugaaccggcucaucgggaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgggagaacgcggaggacauggggaacggcugcuucaagaucuaccacaagugcgacaacgccugcaucggguccauccgcaacggcacguacgaccacgacguguaccgcgacgaggcccucaacaaccgguuccagaucaagggcgucgagcucaagagcggguacaaggacuggauccuguggaucuccuucgccaucagcugcuuccugcugugcguggcccugcucggcuucaucaugugggcgugccagaaggggaacauccgcugcaacaucugcaucuga

SEQ ID NO: 72524 - RNA, 1701 nt, Artificial Sequence; identical to SEQ ID NO: 71002
  derived and/or modified sequence opt1 from hemagglutinin__InfluenzaA__AHL97144

SEQ ID NO: 72525 - RNA, 1701 nt, Artificial Sequence; identical to SEQ ID NO: 71002
  derived and/or modified sequence opt1 from hemagglutinin__InfluenzaA__AHL97156

SEQ ID NO: 72526 - RNA, 1701 nt, Artificial Sequence; identical to SEQ ID NO: 71002
  derived and/or modified sequence opt1 from hemagglutinin__InfluenzaA__AHL97168

SEQ ID NO: 72527 - RNA, 1701 nt, Artificial Sequence; identical to SEQ ID NO: 70876
  derived and/or modified sequence opt1 from hemagglutinin__InfluenzaA__AHL97180

SEQ ID NO: 72528 - RNA, 1701 nt, Artificial Sequence; identical to SEQ ID NO: 71002
  derived and/or modified sequence opt1 from hemagglutinin__InfluenzaA__AHL97192

SEQ ID NO: 72529 - RNA, 1701 nt, Artificial Sequence; identical to SEQ ID NO: 71002
  derived and/or modified sequence opt1 from hemagglutinin__InfluenzaA__AHL97204

SEQ ID NO: 72530 - RNA, 1701 nt, Artificial Sequence; identical to SEQ ID NO: 71002
  derived and/or modified sequence opt1 from hemagglutinin__InfluenzaA__AHL97216

SEQ ID NO: 72531 - RNA, 1701 nt, Artificial Sequence
  derived and/or modified sequence opt1 from hemagglutinin__InfluenzaA__AHL97228
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccgcaucgaggucacgaacgccaccgagcuggugcagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcagccucguggccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcgcaguccagcgggcgcaucaccguguccaccaagcggagccagcaggccgucaucccgaacaucggcagccgcccccggauccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgucaagcagagcacgcugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgugguccugcucggcuucaucaugugggccugccagaaggggaacauccgcugcaacaucugcaucuga

SEQ ID NO: 72532 - RNA, 1701 nt, Artificial Sequence; identical to SEQ ID NO: 71002
  derived and/or modified sequence opt1 from hemagglutinin__InfluenzaA__AHL97240

SEQ ID NO: 72533 - RNA, 1701 nt, Artificial Sequence
  derived and/or modified sequence opt1 from hemagglutinin__InfluenzaA__AHL97252
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagaacuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgcgugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 72534 - RNA, 1701 nt, Artificial Sequence; identical to SEQ ID NO: 70866
  derived and/or modified sequence opt1 from hemagglutinin__InfluenzaA__AHL97264

SEQ ID NO: 72535 - RNA, 1701 nt, Artificial Sequence; identical to SEQ ID NO: 71002
  derived and/or modified sequence opt1 from hemagglutinin__InfluenzaA__AHL97276

SEQ ID NO: 72536 - RNA, 1701 nt, Artificial Sequence
  derived and/or modified sequence opt1 from hemagglutinin__InfluenzaA__AHL97288
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagaucaagaagcagcugcgcgagaacgccgaggacauggggaacggcugcuucaagaucuaccacaagugcgacaacgcgugcaucggguccauccggaacggcacguacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72537 - RNA, 1701 nt, Artificial Sequence; identical to SEQ ID NO: 70876
  derived and/or modified sequence opt1 from hemagglutinin__InfluenzaA__AHL97300

SEQ ID NO: 72538 - RNA, 1701 nt, Artificial Sequence; identical to SEQ ID NO: 71002
  derived and/or modified sequence opt1 from hemagglutinin__InfluenzaA__AHL97312

SEQ ID NO: 72539 - RNA, 1701 nt, Artificial Sequence; identical to SEQ ID NO: 71002
  derived and/or modified sequence opt1 from hemagglutinin__InfluenzaA__AHL97336

SEQ ID NO: 72540 - RNA, 1701 nt, Artificial Sequence; identical to SEQ ID NO: 71002
  derived and/or modified sequence opt1 from hemagglutinin__InfluenzaA__AHL97348

SEQ ID NO: 72541 - RNA, 1701 nt, Artificial Sequence
  derived and/or modified sequence opt1 from hemagglutinin__InfluenzaA__AHL97372
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaacgccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 72542 - RNA, 1701 nt, Artificial Sequence; identical to SEQ ID NO: 71002
  derived and/or modified sequence opt1 from hemagglutinin__InfluenzaA__AHL97384

SEQ ID NO: 72543 - RNA, 1701 nt, Artificial Sequence; identical to SEQ ID NO: 70866
  derived and/or modified sequence opt1 from hemagglutinin__InfluenzaA__AHL97396

SEQ ID NO: 72544 - RNA, 1701 nt, Artificial Sequence; identical to SEQ ID NO: 70843
  derived and/or modified sequence opt1 from hemagglutinin__InfluenzaA__AHL97408

SEQ ID NO: 72545 - RNA, 1701 nt, Artificial Sequence; identical to SEQ ID NO: 72514
  derived and/or modified sequence opt1 from hemagglutinin__InfluenzaA__AHL97420

SEQ ID NO: 72546 - RNA, 1701 nt, Artificial Sequence
  derived and/or modified sequence opt1 from hemagglutinin__InfluenzaA__AHL97444
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacgggaccugcccccgguacgugaagcaguccacgcugaagcucgcgaccggcaugcgcaacguccccgagaagcagacccggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 72547 - RNA, 1701 nt, Artificial Sequence; identical to SEQ ID NO: 70876
  derived and/or modified sequence opt1 from hemagglutinin__InfluenzaA__AHL97456

SEQ ID NO: 72548 - RNA, 1701 nt, Artificial Sequence
  derived and/or modified sequence opt1 from hemagglutinin__InfluenzaA__AHL97468
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugauggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 72549 - RNA, 1701 nt, Artificial Sequence; identical to SEQ ID NO: 71002
  derived and/or modified sequence opt1 from hemagglutinin__InfluenzaA__AHL97480

SEQ ID NO: 72550 - RNA, 1701 nt, Artificial Sequence; identical to SEQ ID NO: 71002
  derived and/or modified sequence opt1 from hemagglutinin__InfluenzaA__AHL97493

SEQ ID NO: 72551 - RNA, 1701 nt, Artificial Sequence; identical to SEQ ID NO: 72514
  derived and/or modified sequence opt1 from hemagglutinin__InfluenzaA__AHL97505

SEQ ID NO: 72552 - RNA, 1701 nt, Artificial Sequence
  derived and/or modified sequence opt1 from hemagglutinin__InfluenzaA__AHL97517
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcacccagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72553 - RNA, 1701 nt, Artificial Sequence; identical to SEQ ID NO: 70891
  derived and/or modified sequence opt1 from hemagglutinin__InfluenzaA__AHL97529

SEQ ID NO: 72554 - RNA, 1701 nt, Artificial Sequence; identical to SEQ ID NO: 70876
  derived and/or modified sequence opt1 from hemagglutinin__InfluenzaA__AHL97541

SEQ ID NO: 72555 - RNA, 1701 nt, Artificial Sequence; identical to SEQ ID NO: 71002
  derived and/or modified sequence opt1 from hemagglutinin__InfluenzaA__AHL97553

SEQ ID NO: 72556 - RNA, 1701 nt, Artificial Sequence; identical to SEQ ID NO: 70843
  derived and/or modified sequence opt1 from hemagglutinin__InfluenzaA__AHL97565

SEQ ID NO: 72557 - RNA, 1701 nt, Artificial Sequence
  derived and/or modified sequence opt1 from hemagglutinin__InfluenzaA__AHL97577
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgggggagcaacuccagcuucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccggccggaucaccgugagcaccaagcgcagccagcaggccgugaucccgaacaucggcucccggccccgcauccggaacauccccagccgcaucuccaucuacuggacgaucgucaagcccggggacauccugcugaucaacagcaccggcaaccucaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacgcugaagcuggcgaccgggaugcgcaacguccccgagaagcagacccggggcaucuucggggccaucgccggcuucaucgagaacggcugggaggggaugguggacggcugguacggguuccgccaccagaacagcgagggccgggggcaggccgccgaccucaaguccacccaggcggccaucgaccagaucaacggcaagcugaaccgccugaucggcaagacgaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugaccgacagcgagaugaacaagcuguucgagcgcacgaagaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcgucgagcucaagcccggcuacaaggacuggauccuguggaucagcuucgccaucuccugcuuccugcucugcguggcccugcugggguucaucaugugggccugccagaagggcaacauccgcugcaacaucugcaucuga

SEQ ID NO: 72558 - RNA, 1701 nt, Artificial Sequence; identical to SEQ ID NO: 71031
  derived and/or modified sequence opt1 from hemagglutinin__InfluenzaA__AHL97589

SEQ ID NO: 72559 - RNA, 1701 nt, Artificial Sequence; identical to SEQ ID NO: 71002
  derived and/or modified sequence opt1 from hemagglutinin__InfluenzaA__AHL97601

SEQ ID NO: 72560 - RNA, 1701 nt, Artificial Sequence; identical to SEQ ID NO: 70866
  derived and/or modified sequence opt1 from hemagglutinin__InfluenzaA__AHL97613

SEQ ID NO: 72561 - RNA, 1701 nt, Artificial Sequence; identical to SEQ ID NO: 72548
  derived and/or modified sequence opt1 from hemagglutinin__InfluenzaA__AHL97625

SEQ ID NO: 72562 - RNA, 1701 nt, Artificial Sequence; identical to SEQ ID NO: 70876
  derived and/or modified sequence opt1 from hemagglutinin__InfluenzaA__AHL97637

SEQ ID NO: 72563 - RNA, 1701 nt, Artificial Sequence
  derived and/or modified sequence opt1 from hemagglutinin__InfluenzaA__AHL97661
augaagaccaucaucgcccugggcuacauccucugccugguguucgcccagaagcugcccgggaacgacaacagcaccgcgacgcucugccugggccaccacgccgucccgaacgggaccaucgugaagaccaucaccaacgaccgcaucgaggugacgaacgccaccgagcugguccagaacuccagcaucggcgagaucugcgacagcccccaccagauccucgacggggagaacugcacccugaucgacgcccugcucggcgacccccagugcgacggcuuccagaacaagaagugggaccuguucguggagcggagcaaggccuacuccaacugcuaccccuacgacgugccggacuacgcgagccugcgcucccucgucgccagcuccgggacccuggaguucaacaacgagagcuucaacuggacgggcgugacccagaacgggaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcggccgcaucaccguguccaccaagcggagccagcaggccgugaucccgaacaucggcagccgcccccggauccgcaacauccccucccggaucagcaucuacuggacgaucgucaagcccggggacauccugcucaucaacuccaccggcaaccugaucgccccgcgcggguacuucaagauccggagcggcaaguccagcaucaugcgcuccgacgcccccaucggcaagugcaagagcgagugcaucacccccaacggguccauccccaacgacaagccguuccagaacgugaaccggaucaccuacggcgccugcccccgcuacgugaagcagagcacgcugaagcucgcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccugaaguccacccaggcggccaucgaccagaucaacggcaagcugaaccggcucaucggcaagacgaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcagcauccggaacgggaccuacgaccacaacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 72564 - RNA, 1701 nt, Artificial Sequence
  derived and/or modified sequence opt1 from hemagglutinin__InfluenzaA__AHL97673
augaagaccaccaucgcccugagcuacauccucugccugguguucgcccaggagcugcccggcaacgacgacuccacggcgacccucugccuggggcaccacgccgucccgaacggcaccaucgugaagaccaucacgaacgaccagaucgaggugaccaacgccaccgagcugguccagagcuccagcaccggggagaucugcaacagcccccaccagauccucgacggcgagaacugcacgcugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacccuggaguucaacaacgagagcuucaacuggaccggggugacccagaacggcacguccagcgccugcauccgccgguccaacaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucacgguguccaccaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 72565 - RNA, 1701 nt, Artificial Sequence; identical to SEQ ID NO: 71002
  derived and/or modified sequence opt1 from hemagglutinin__InfluenzaA__AHL97685

SEQ ID NO: 72566 - RNA, 1701 nt, Artificial Sequence
  derived and/or modified sequence opt1 from hemagglutinin__InfluenzaA__AHL97697
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcggggcaaggccuacuccaacugcuaccccuacgacgugccggacuacgcgagccugcgcucccucgucgccagcuccgggacccuggaguucaacaacgagagcuucaacugggccggcgugacgcagaacgggaccuccagcgccugcauccggggcuccaacagcuccuucuucagccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccggaucaccguguccaccaagcgcagccagcaggccgugaucccgaacaucgggagccggccccgcauccggaacauccccucccgcaucagcaucuacuggaccaucgucaagcccggcgacauccugcucaucaacuccacggggaaccugaucgccccgcggggcuacuucaagauccgcagcggcaaguccagcaucaugcgguccgacgcccccaucgggaagugcaagagcgagugcaucacccccaacggcuccauccccaacgacaagccguuccagaacgugaaccgcaucaccuacggggcgugcccccgguacgugaagcagagcacccugaagcucgccacgggcaugcgcaacguccccgagaagcagacccgggggaucuucggcgccaucgccggcuucaucgagaacgggugggagggcaugguggacgggugguacggcuuccgccaccagaacuccgaggggcggggccaggccgcggaccucaagagcacccaggccgccaucgaccagaucaacggcaagcugaaccgccugaucgggaagaccaacgagaaguuccaccagaucgagaaggaguucuccgagguggagggccggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccgcaacggcacguacgaccacgacguguaccgggacgaggcccucaacaaccgcuuccagaucaagggcgucgagcugaaguccggguacaaggacuggauccuguggaucagcuucgccaucuccugcuuccuccugugcguggcccugcucggcuucaucaugugggcgugccagaaggggaacauccggugcaacaucugcaucuga

SEQ ID NO: 72567 - RNA, 1701 nt, Artificial Sequence; identical to SEQ ID NO: 70876
  derived and/or modified sequence opt1 from hemagglutinin__InfluenzaA__AHL97709

SEQ ID NO: 72568 - RNA, 1701 nt, Artificial Sequence; identical to SEQ ID NO: 71002
  derived and/or modified sequence opt1 from hemagglutinin__InfluenzaA__AHL97721

SEQ ID NO: 72569 - RNA, 1701 nt, Artificial Sequence; identical to SEQ ID NO: 70876
  derived and/or modified sequence opt1 from hemagglutinin__InfluenzaA__AHL97733

SEQ ID NO: 72570 - RNA, 1701 nt, Artificial Sequence; identical to SEQ ID NO: 70866
  derived and/or modified sequence opt1 from hemagglutinin__InfluenzaA__AHL97745

SEQ ID NO: 72571 - RNA, 1701 nt, Artificial Sequence; identical to SEQ ID NO: 71002
  derived and/or modified sequence opt1 from hemagglutinin__InfluenzaA__AHL97757

SEQ ID NO: 72572 - RNA, 1701 nt, Artificial Sequence; identical to SEQ ID NO: 71002
  derived and/or modified sequence opt1 from hemagglutinin__InfluenzaA__AHL97769

SEQ ID NO: 72573 - RNA, 1701 nt, Artificial Sequence
  derived and/or modified sequence opt1 from hemagglutinin__InfluenzaA__AHL97781
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaacuccagcaucaugcgguccgacgcccccaucggcaagugcaacagcacgugcaucacccccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 72574 - RNA, 1701 nt, Artificial Sequence; identical to SEQ ID NO: 71002
  derived and/or modified sequence opt1 from hemagglutinin__InfluenzaA__AHL97793

SEQ ID NO: 72575 - RNA, 1701 nt, Artificial Sequence
  derived and/or modified sequence opt1 from hemagglutinin__InfluenzaA__AHL97805
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacuacgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 72576 - RNA, 1701 nt, Artificial Sequence; identical to SEQ ID NO: 70876
  derived and/or modified sequence opt1 from hemagglutinin__InfluenzaA__AHL97817

SEQ ID NO: 72577 - RNA, 1701 nt, Artificial Sequence; identical to SEQ ID NO: 72566
  derived and/or modified sequence opt1 from hemagglutinin__InfluenzaA__AHL97829

SEQ ID NO: 72578 - RNA, 1701 nt, Artificial Sequence; identical to SEQ ID NO: 71002
  derived and/or modified sequence opt1 from hemagglutinin__InfluenzaA__AHL97841

SEQ ID NO: 72579 - RNA, 1701 nt, Artificial Sequence; identical to SEQ ID NO: 71002
  derived and/or modified sequence opt1 from hemagglutinin__InfluenzaA__AHL97853

SEQ ID NO: 72580 - RNA, 1701 nt, Artificial Sequence; identical to SEQ ID NO: 71002
  derived and/or modified sequence opt1 from hemagglutinin__InfluenzaA__AHL97865

SEQ ID NO: 72581 - RNA, 1701 nt, Artificial Sequence; identical to SEQ ID NO: 71002
  derived and/or modified sequence opt1 from hemagglutinin__InfluenzaA__AHL97877

SEQ ID NO: 72582 - RNA, 1701 nt, Artificial Sequence; identical to SEQ ID NO: 70876
  derived and/or modified sequence opt1 from hemagglutinin__InfluenzaA__AHL97889

SEQ ID NO: 72583 - RNA, 1701 nt, Artificial Sequence; identical to SEQ ID NO: 70876
  derived and/or modified sequence opt1 from hemagglutinin__InfluenzaA__AHL97901

SEQ ID NO: 72584 - RNA, 1701 nt, Artificial Sequence; identical to SEQ ID NO: 70866
  derived and/or modified sequence opt1 from hemagglutinin__InfluenzaA__AHL97913

SEQ ID NO: 72585 - RNA, 1701 nt, Artificial Sequence
  derived and/or modified sequence opt1 from hemagglutinin__InfluenzaA__AHL97925
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccacuccaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcugcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaaggggguggagcucaagagcggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 72586 - RNA, 1701 nt, Artificial Sequence; identical to SEQ ID NO: 70866
  derived and/or modified sequence opt1 from hemagglutinin__InfluenzaA__AHL97937

SEQ ID NO: 72587 - RNA, 1701 nt, Artificial Sequence; identical to SEQ ID NO: 72546
  derived and/or modified sequence opt1 from hemagglutinin__InfluenzaA__AHL97949

SEQ ID NO: 72588 - RNA, 1701 nt, Artificial Sequence; identical to SEQ ID NO: 70876
  derived and/or modified sequence opt1 from hemagglutinin__InfluenzaA__AHL97961

SEQ ID NO: 72589 - RNA, 1701 nt, Artificial Sequence; identical to SEQ ID NO: 70876
  derived and/or modified sequence opt1 from hemagglutinin__InfluenzaA__AHL97973

SEQ ID NO: 72590 - RNA, 1701 nt, Artificial Sequence; identical to SEQ ID NO: 70876
  derived and/or modified sequence opt1 from hemagglutinin__InfluenzaA__AHL97985

SEQ ID NO: 72591 - RNA, 1701 nt, Artificial Sequence
  derived and/or modified sequence opt1 from hemagglutinin__InfluenzaA__AHL97997
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagauccgcggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 72592 - RNA, 1701 nt, Artificial Sequence; identical to SEQ ID NO: 71002
  derived and/or modified sequence opt1 from hemagglutinin__InfluenzaA__AHL98009

SEQ ID NO: 72593 - RNA, 1701 nt, Artificial Sequence
  derived and/or modified sequence opt1 from hemagglutinin__InfluenzaA__AHL98021
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucgggaagaucugcgacagcccccaccagauccucgacggcgagaacugcacccugauggacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccggcgcagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcgcaucaccgugagcaccaagcggagccagcaggccgugaucccgaacaucggcucccgcccccggauccgcaacauccccagccggaucuccaucuacuggaccaucgucaagcccggcgacauccugcucaucaacagcacggggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggcgugcccccgcuacgugaagcaguccacccugaagcucgccacgggcaugcggaacguccccgagaagcagacccgcgggaucuucggcgccaucgccggguucaucgagaacggcugggagggcaugauggacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacauggggaacggcugcuucaagaucuaccacaagugcgacaacgccugcaucggguccauccggaacggcacguacgaccacaacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggcgugccagaaggggaacauccgcugcaacaucugcaucuga

SEQ ID NO: 72594 - RNA, 1701 nt, Artificial Sequence; identical to SEQ ID NO: 70876
  derived and/or modified sequence opt1 from hemagglutinin__InfluenzaA__AHL98033

SEQ ID NO: 72595 - RNA, 1701 nt, Artificial Sequence; identical to SEQ ID NO: 72473
  derived and/or modified sequence opt1 from hemagglutinin__InfluenzaA__AHL98045

SEQ ID NO: 72596 - RNA, 1701 nt, Artificial Sequence; identical to SEQ ID NO: 72473
  derived and/or modified sequence opt1 from hemagglutinin__InfluenzaA__AHL98057

SEQ ID NO: 72597 - RNA, 1701 nt, Artificial Sequence; identical to SEQ ID NO: 72473
  derived and/or modified sequence opt1 from hemagglutinin__InfluenzaA__AHL98069

SEQ ID NO: 72598 - RNA, 1701 nt, Artificial Sequence
  derived and/or modified sequence opt1 from hemagglutinin__InfluenzaA__AHL98081
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccgcaagagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcacccagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucgugggcaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 72599 - RNA, 1701 nt, Artificial Sequence; identical to SEQ ID NO: 70866
  derived and/or modified sequence opt1 from hemagglutinin__InfluenzaA__AHL98093

SEQ ID NO: 72600 - RNA, 1701 nt, Artificial Sequence
  derived and/or modified sequence opt1 from hemagglutinin__InfluenzaA__AHL98105
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccggcagcgacaacggcacgugcuaccccggggacuucaucgacuacgaggagcugcgggagcagcucuccagcguguccagcuucgagcgcuucgagaucuuccccaagaccuccagcuggcccaaccacgacuccaacaagggcgucaccgccgccugcccgcacgccggggcgaagggcuucuacaagaaccugaucuggcuggugaagaaggggaacagcuaccccaagcucuccaucagcuacaucaacgacaagggcaaggaggugcugguccuguggggcauccaccaccccuccaccacggccgaccagcagagccucuaccagaacgccgacaccuacguguucgugggggccagccgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucgccauggagcgcaacgccggcagcgggaucaucaucuccgacacccccgugcacgacugcaacacgaccugccagaccccgaagggcgccaucaacaccagccuccccuuccagaacauccaccccaucaccaucgggaagugccccaaguacgugaaguccaccaagcugcggcuggcgacgggccuccgcaacgucccgagcauccagucccgggggcuguucggcgccaucgccggcuucaucgagggcggguggaccgggaugguggacggcugguacggguaccaccaccagaacgagcagggcagcggcuacgccgccgaccugaaguccacccagaacgcgaucgacaagaucaccaacaaggugaacagcgucaucgagaagaugaacacgcaguucaccgccguggggaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgccgccagcucccugguccugguggugagccucggcgccaucuccuucuggaugugcagcaacgggagccugcagugccggaucugcaucuga

SEQ ID NO: 72601 - RNA, 1701 nt, Artificial Sequence; identical to SEQ ID NO: 70866
  derived and/or modified sequence opt1 from hemagglutinin__InfluenzaA__AHL98116

SEQ ID NO: 72602 - RNA, 1701 nt, Artificial Sequence; identical to SEQ ID NO: 70876
  derived and/or modified sequence opt1 from hemagglutinin__InfluenzaA__AHL98128

SEQ ID NO: 72603 - RNA, 1701 nt, Artificial Sequence; identical to SEQ ID NO: 70866
  derived and/or modified sequence opt1 from hemagglutinin__InfluenzaA__AHL98140

SEQ ID NO: 72604 - RNA, 1701 nt, Artificial Sequence; identical to SEQ ID NO: 70866
  derived and/or modified sequence opt1 from hemagglutinin__InfluenzaA__AHL98152

SEQ ID NO: 72605 - RNA, 1701 nt, Artificial Sequence; identical to SEQ ID NO: 70876
  derived and/or modified sequence opt1 from hemagglutinin__InfluenzaA__AHL98164

SEQ ID NO: 72606 - RNA, 1701 nt, Artificial Sequence; identical to SEQ ID NO: 70876
  derived and/or modified sequence opt1 from hemagglutinin__InfluenzaA__AHL98176

SEQ ID NO: 72607 - RNA, 1701 nt, Artificial Sequence; identical to SEQ ID NO: 70866
  derived and/or modified sequence opt1 from hemagglutinin__InfluenzaA__AHL98188

SEQ ID NO: 72608 - RNA, 1701 nt, Artificial Sequence; identical to SEQ ID NO: 71031
  derived and/or modified sequence opt1 from hemagglutinin__InfluenzaA__AHL98200

SEQ ID NO: 72609 - RNA, 1701 nt, Artificial Sequence; identical to SEQ ID NO: 70866
  derived and/or modified sequence opt1 from hemagglutinin__InfluenzaA__AHL98212

SEQ ID NO: 72610 - RNA, 1701 nt, Artificial Sequence; identical to SEQ ID NO: 70866
  derived and/or modified sequence opt1 from hemagglutinin__InfluenzaA__AHL98224

SEQ ID NO: 72611 - RNA, 1701 nt, Artificial Sequence; identical to SEQ ID NO: 71002
  derived and/or modified sequence opt1 from hemagglutinin__InfluenzaA__AHL98236

SEQ ID NO: 72612 - RNA, 1701 nt, Artificial Sequence; identical to SEQ ID NO: 70876
  derived and/or modified sequence opt1 from hemagglutinin__InfluenzaA__AHL98248

SEQ ID NO: 72613 - RNA, 1701 nt, Artificial Sequence; identical to SEQ ID NO: 70866
  derived and/or modified sequence opt1 from hemagglutinin__InfluenzaA__AHL98260

SEQ ID NO: 72614 - RNA, 1701 nt, Artificial Sequence; identical to SEQ ID NO: 70876
  derived and/or modified sequence opt1 from hemagglutinin__InfluenzaA__AHL98272

SEQ ID NO: 72615 - RNA, 1701 nt, Artificial Sequence; identical to SEQ ID NO: 72472
  derived and/or modified sequence opt1 from hemagglutinin__InfluenzaA__AHL98284

SEQ ID NO: 72616 - RNA, 1701 nt, Artificial Sequence
  derived and/or modified sequence opt1 from hemagglutinin__InfluenzaA__AHL98295
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacugggccggggugacgcagaacggcaccagcuccgccugcauccgggggagcaacuccagcuucuucucccgccugaacuggcugacccaccucaacuucaaguaccccgcgcugaacgugaccaugcccaacaacgagcaguucgacaagcuguacaucuggggcguccaccaccccgggacggacaaggaccagaucuuccucuacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcugaucaacagcacgggcaaccucaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcuggccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacguggaggacacgaagaucgaccugugguccuacaacgccgagcugcucgucgcccuggagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcguggagcucaagagcggcuacaaggacuggauccuguggaucuccuucgccaucagcugcuuccugcucugcgucgcccugcugggguucaucaugugggcgugccagaagggcaacauccggugcaacaucugcaucuga

SEQ ID NO: 72617 - RNA, 1701 nt, Artificial Sequence; identical to SEQ ID NO: 72514
  derived and/or modified sequence opt1 from hemagglutinin__InfluenzaA__AHL98307

SEQ ID NO: 72618 - RNA, 1701 nt, Artificial Sequence; identical to SEQ ID NO: 70876
  derived and/or modified sequence opt1 from hemagglutinin__InfluenzaA__AHL98319

SEQ ID NO: 72619 - RNA, 1701 nt, Artificial Sequence; identical to SEQ ID NO: 70876
  derived and/or modified sequence opt1 from hemagglutinin__InfluenzaA__AHL98331

SEQ ID NO: 72620 - RNA, 1701 nt, Artificial Sequence; identical to SEQ ID NO: 71002
  derived and/or modified sequence opt1 from hemagglutinin__InfluenzaA__AHL98343

SEQ ID NO: 72621 - RNA, 1701 nt, Artificial Sequence; identical to SEQ ID NO: 72514
  derived and/or modified sequence opt1 from hemagglutinin__InfluenzaA__AHL98354

SEQ ID NO: 72622 - RNA, 1701 nt, Artificial Sequence; identical to SEQ ID NO: 70866
  derived and/or modified sequence opt1 from hemagglutinin__InfluenzaA__AHL98366

SEQ ID NO: 72623 - RNA, 1701 nt, Artificial Sequence; identical to SEQ ID NO: 70866
  derived and/or modified sequence opt1 from hemagglutinin__InfluenzaA__AHL98378

SEQ ID NO: 72624 - RNA, 1701 nt, Artificial Sequence; identical to SEQ ID NO: 70866
  derived and/or modified sequence opt1 from hemagglutinin__InfluenzaA__AHL98390

SEQ ID NO: 72625 - RNA, 1701 nt, Artificial Sequence; identical to SEQ ID NO: 70866
  derived and/or modified sequence opt1 from hemagglutinin__InfluenzaA__AHL98402

SEQ ID NO: 72626 - RNA, 1701 nt, Artificial Sequence; identical to SEQ ID NO: 70876
  derived and/or modified sequence opt1 from hemagglutinin__InfluenzaA__AHL98414

SEQ ID NO: 72627 - RNA, 1701 nt, Artificial Sequence
  derived and/or modified sequence opt1 from hemagglutinin__InfluenzaA__AHL98426
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccacuccaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccaggugaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 72628 - RNA, 1701 nt, Artificial Sequence; identical to SEQ ID NO: 71048
  derived and/or modified sequence opt1 from hemagglutinin__InfluenzaA__AHL98438

SEQ ID NO: 72629 - RNA, 1701 nt, Artificial Sequence; identical to SEQ ID NO: 71048
  derived and/or modified sequence opt1 from hemagglutinin__InfluenzaA__AHL98449

SEQ ID NO: 72630 - RNA, 1701 nt, Artificial Sequence
  derived and/or modified sequence opt1 from hemagglutinin__InfluenzaA__AHL98471
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagaaguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugcgcgaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccggguccggcaucaucaucagcgacacccccguccacgacugcaacacgaccugccagaccccggagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcaaccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggagaagaucgacggcgugaagcucgaguccacccgcaucuaccagauccuggcgaucuacagcaccguggccuccagccugguccucguggugucccugggggccaucagcuucuggaugugcagcaacggcucccugcagugccggaucugcaucuga

SEQ ID NO: 72631 - RNA, 1701 nt, Artificial Sequence; identical to SEQ ID NO: 71002
  derived and/or modified sequence opt1 from hemagglutinin__InfluenzaA__AHL98482

SEQ ID NO: 72632 - RNA, 1701 nt, Artificial Sequence; identical to SEQ ID NO: 70843
  derived and/or modified sequence opt1 from hemagglutinin__InfluenzaA__AHL98494

SEQ ID NO: 72633 - RNA, 1701 nt, Artificial Sequence; identical to SEQ ID NO: 71002
  derived and/or modified sequence opt1 from hemagglutinin__InfluenzaA__AHL98506

SEQ ID NO: 72634 - RNA, 1701 nt, Artificial Sequence; identical to SEQ ID NO: 71002
  derived and/or modified sequence opt1 from hemagglutinin__InfluenzaA__AHL98518

SEQ ID NO: 72635 - RNA, 1701 nt, Artificial Sequence; identical to SEQ ID NO: 70843
  derived and/or modified sequence opt1 from hemagglutinin__InfluenzaA__AHL98530

SEQ ID NO: 72636 - RNA, 1701 nt, Artificial Sequence; identical to SEQ ID NO: 71002
  derived and/or modified sequence opt1 from hemagglutinin__InfluenzaA__AHL98542

SEQ ID NO: 72637 - RNA, 1701 nt, Artificial Sequence; identical to SEQ ID NO: 71002
  derived and/or modified sequence opt1 from hemagglutinin__InfluenzaA__AHL98554

SEQ ID NO: 72638 - RNA, 1701 nt, Artificial Sequence; identical to SEQ ID NO: 70876
  derived and/or modified sequence opt1 from hemagglutinin__InfluenzaA__AHL98566

SEQ ID NO: 72639 - RNA, 1701 nt, Artificial Sequence; identical to SEQ ID NO: 70876
  derived and/or modified sequence opt1 from hemagglutinin__InfluenzaA__AHL98578

SEQ ID NO: 72640 - RNA, 1701 nt, Artificial Sequence; identical to SEQ ID NO: 71002
  derived and/or modified sequence opt1 from hemagglutinin__InfluenzaA__AHL98590

SEQ ID NO: 72641 - RNA, 1701 nt, Artificial Sequence; identical to SEQ ID NO: 70866
  derived and/or modified sequence opt1 from hemagglutinin__InfluenzaA__AHL98602

SEQ ID NO: 72642 - RNA, 1701 nt, Artificial Sequence; identical to SEQ ID NO: 70843
  derived and/or modified sequence opt1 from hemagglutinin__InfluenzaA__AHL98614

SEQ ID NO: 72643 - RNA, 1701 nt, Artificial Sequence
  derived and/or modified sequence opt1 from hemagglutinin__InfluenzaA__AHL98626
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagcgcugggaccuguucguggagcggagcaaggcccacuccaacugcuaccccuacgacgugccggacuacgcgagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggagccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 72644 - RNA, 1701 nt, Artificial Sequence; identical to SEQ ID NO: 70866
  derived and/or modified sequence opt1 from hemagglutinin__InfluenzaA__AHL98638

SEQ ID NO: 72645 - RNA, 1701 nt, Artificial Sequence; identical to SEQ ID NO: 70876
  derived and/or modified sequence opt1 from hemagglutinin__InfluenzaA__AHL98650

SEQ ID NO: 72646 - RNA, 1701 nt, Artificial Sequence
  derived and/or modified sequence opt1 from hemagglutinin__InfluenzaA__AHL98662
augaagaccaucaucgcccugagcuacauccucugccugguguucgcccagaagcugcccggcaacgacaacuccaccgcgacgcucugccuggggcaccacgccgucccgaacggcaccauggugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccacuccaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaaggggguggagcucaagagcggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 72647 - RNA, 1701 nt, Artificial Sequence; identical to SEQ ID NO: 72514
  derived and/or modified sequence opt1 from hemagglutinin__InfluenzaA__AHL98674

SEQ ID NO: 72648 - RNA, 1701 nt, Artificial Sequence; identical to SEQ ID NO: 70866
  derived and/or modified sequence opt1 from hemagglutinin__InfluenzaA__AHL98686

SEQ ID NO: 72649 - RNA, 1701 nt, Artificial Sequence; identical to SEQ ID NO: 71002
  derived and/or modified sequence opt1 from hemagglutinin__InfluenzaA__AHL98699

SEQ ID NO: 72650 - RNA, 1701 nt, Artificial Sequence; identical to SEQ ID NO: 71131
  derived and/or modified sequence opt1 from hemagglutinin__InfluenzaA__AHL98711

SEQ ID NO: 72651 - RNA, 1701 nt, Artificial Sequence; identical to SEQ ID NO: 71475
  derived and/or modified sequence opt1 from hemagglutinin__InfluenzaA__AHL98722

SEQ ID NO: 72652 - RNA, 1701 nt, Artificial Sequence; identical to SEQ ID NO: 70876
  derived and/or modified sequence opt1 from hemagglutinin__InfluenzaA__AHL98734

SEQ ID NO: 72653 - RNA, 1701 nt, Artificial Sequence; identical to SEQ ID NO: 71002
  derived and/or modified sequence opt1 from hemagglutinin__InfluenzaA__AHL98746

SEQ ID NO: 72654 - RNA, 1701 nt, Artificial Sequence; identical to SEQ ID NO: 70876
  derived and/or modified sequence opt1 from hemagglutinin__InfluenzaA__AHL98758

SEQ ID NO: 72655 - RNA, 1701 nt, Artificial Sequence; identical to SEQ ID NO: 70866
  derived and/or modified sequence opt1 from hemagglutinin__InfluenzaA__AHL98770

SEQ ID NO: 72656 - RNA, 1701 nt, Artificial Sequence; identical to SEQ ID NO: 71005
  derived and/or modified sequence opt1 from hemagglutinin__InfluenzaA__AHL98782

SEQ ID NO: 72657 - RNA, 1701 nt, Artificial Sequence
  derived and/or modified sequence opt1 from hemagglutinin__InfluenzaA__AHL98794
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugccgcuccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 72658 - RNA, 1701 nt, Artificial Sequence
  derived and/or modified sequence opt1 from hemagglutinin__InfluenzaA__AHL98806
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccagaccgccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 72659 - RNA, 1701 nt, Artificial Sequence; identical to SEQ ID NO: 70866
  derived and/or modified sequence opt1 from hemagglutinin__InfluenzaA__AHL98818

SEQ ID NO: 72660 - RNA, 1701 nt, Artificial Sequence; identical to SEQ ID NO: 70876
  derived and/or modified sequence opt1 from hemagglutinin__InfluenzaA__AHL98830

SEQ ID NO: 72661 - RNA, 1701 nt, Artificial Sequence; identical to SEQ ID NO: 70866
  derived and/or modified sequence opt1 from hemagglutinin__InfluenzaA__AHL98842

SEQ ID NO: 72662 - RNA, 1701 nt, Artificial Sequence; identical to SEQ ID NO: 70866
  derived and/or modified sequence opt1 from hemagglutinin__InfluenzaA__AHL98854

SEQ ID NO: 72663 - RNA, 1701 nt, Artificial Sequence
  derived and/or modified sequence opt1 from hemagglutinin__InfluenzaA__AHL98878
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccgcaucgaggugaccaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgccucccugcgcagccucgucgcguccagcggcacgcuggaguucaacaacgaguccuucaacuggaccggggugacccagaacggcaccagcuccgccugcauccggcgcagcaacuccagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccagagcuccgggcgcaucaccgugagcacgaagcggagccagcaggcggugaucccgaacaucggcucccgcccccggauccgcaacauccccagccggaucuccaucuacuggaccaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcaguccacccugaagcucgccaccggcaugcggaacguccccgagaagcagacccgcgggaucuucggcgcgaucgccggguucaucgagaacggcugggagggcaugguggacgggugguacggcuuccggcaccagaacagcgaggggcgcggccaggccgccgaccugaaguccacgcaggccgcgaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccggaacggcaccuacgaccacaacguguaccgcgacgaggcgcucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72664 - RNA, 1701 nt, Artificial Sequence
  derived and/or modified sequence opt1 from hemagglutinin__InfluenzaA__AHL98890
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugccugcugcugugcguggcccuccugggguucaucaugugggcgugccagaagggcaacauccggugcaacaucugcaucuga

SEQ ID NO: 72665 - RNA, 1701 nt, Artificial Sequence
  derived and/or modified sequence opt1 from hemagglutinin__InfluenzaA__AHL98902
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccgcaucgaggucacgaacgccaccgagcuggugcagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcagccucguggccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgucaccaugcccaacaacgagcaguucgacaagcucuacaucuggggcgugcaccaccccgggacggacaaggaccagaucuuccuguacgcccagagcuccggccggaucaccgugagcaccaagcgcagccagcaggccgucaucccgaacaucggcucccggccccgcauccggaacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgucaagcaguccacccugaagcucgccacggggaugcgcaacgugcccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 72666 - RNA, 1701 nt, Artificial Sequence; identical to SEQ ID NO: 70876
  derived and/or modified sequence opt1 from hemagglutinin__InfluenzaA__AHL98913

SEQ ID NO: 72667 - RNA, 1701 nt, Artificial Sequence; identical to SEQ ID NO: 70866
  derived and/or modified sequence opt1 from hemagglutinin__InfluenzaA__AHL98925

SEQ ID NO: 72668 - RNA, 1701 nt, Artificial Sequence; identical to SEQ ID NO: 71005
  derived and/or modified sequence opt1 from hemagglutinin__InfluenzaA__AHL98937

SEQ ID NO: 72669 - RNA, 1701 nt, Artificial Sequence; identical to SEQ ID NO: 71002
  derived and/or modified sequence opt1 from hemagglutinin__InfluenzaA__AHL98961

SEQ ID NO: 72670 - RNA, 1701 nt, Artificial Sequence
  derived and/or modified sequence opt1 from hemagglutinin__InfluenzaA__AHL98973
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccguggucccgaacaucggcucccgcccccggauccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgucaagcaguccacgcugaagcucgcgaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcucaagagcggcuacaaggacuggauccuguggaucuccuucgccaugagcugcuuccugcugugcguggcccugcucggcuucaucaugugggccugccagaaggggaacauccgcugcaacaucugcaucuga

SEQ ID NO: 72671 - RNA, 1701 nt, Artificial Sequence
  derived and/or modified sequence opt1 from hemagglutinin__InfluenzaA__AHL98985
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcaccaucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacugggccggggugacgcagaacggcaccagcuccgccugcauccgggggagcaacuccagcuucuucucccgccugaacuggcugacccaccucaacuucaaguaccccgcgcugaacgugaccaugcccaacaacgagcaguucgacaagcuguacaucuggggcguccaccaccccgggacggacaaggaccagaucuuccucuacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcugaucaacagcacgggcaaccucaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcuggccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacgucgaggacacgaagaucgaccugugguccuacaacgccgagcugcucguggcccuggagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 72672 - RNA, 1701 nt, Artificial Sequence; identical to SEQ ID NO: 71002
  derived and/or modified sequence opt1 from hemagglutinin__InfluenzaA__AHL98997

SEQ ID NO: 72673 - RNA, 1701 nt, Artificial Sequence; identical to SEQ ID NO: 70866
  derived and/or modified sequence opt1 from hemagglutinin__InfluenzaA__AHL99009

SEQ ID NO: 72674 - RNA, 1701 nt, Artificial Sequence; identical to SEQ ID NO: 70876
  derived and/or modified sequence opt1 from hemagglutinin__InfluenzaA__AHL99021

SEQ ID NO: 72675 - RNA, 1701 nt, Artificial Sequence
  derived and/or modified sequence opt1 from hemagglutinin__InfluenzaA__AHL99045
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcaacuccagcuucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacgggcccugcccccgcuacgugaagcaguccacgcugaagcuggccaccggcaugcggaacguccccgagaagcagacccgcgggaucuucggcgcgaucgccggguucaucgagaacggcugggagggcaugguggacgggugguacggcuuccggcaccagaacagcgaggggcgcggccaggccgccgaccucaaguccacccaggccgcgaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgccugcaucggguccauccggaacggcaccuacgaccacgacguguaccgcgacgaggcgcugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 72676 - RNA, 1701 nt, Artificial Sequence
  derived and/or modified sequence opt1 from hemagglutinin__InfluenzaA__AHL99057
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagaucaucgacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacugggccggggugacgcagaacggcaccagcuccgccugcauccgggggagcaacuccagcuucuucucccgccugaacuggcugacccaccucaacuucaaguaccccgcgcugaacgugaccaugcccaacaacgagcaguucgacaagcuguacaucuggggcguccaccaccccgggacggacaaggaccagaucuuccucuacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcugaucaacagcacgggcaaccucaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcuggccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacgucgaggacacgaagaucgaccugugguccuacaacgccgagcugcucguggcccuggagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 72677 - RNA, 1701 nt, Artificial Sequence
  derived and/or modified sequence opt1 from hemagglutinin__InfluenzaA__AHL99069
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacacgcugcucaucaacagcaccggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacgcugaagcucgccaccgggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacaacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 72678 - RNA, 1701 nt, Artificial Sequence
  derived and/or modified sequence opt1 from hemagglutinin__InfluenzaA__AHL99081
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcagggcacgcugaagcucgcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagacgaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcagcauccggaacgggaccuacgaccacaacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 72679 - RNA, 1701 nt, Artificial Sequence
  derived and/or modified sequence opt1 from hemagglutinin__InfluenzaA__AHL99093
augaagaccaucaucgcccugagcuacauccucugccugaucuucgcccagaagcugcccggcaacgacaacuccaccgcgacgcucugccuggggcaccacgccgugccgaacggcaccaucgucaagaccaucaccaacgaccgcaucgaggugacgaacgccaccgagcuggugcagaacagcuccaucggggagaucugcgacagcccccaccagauccucgacggcgagaacugcacccugaucgacgcccugcucggggacccccagugcgacggcuuccagaacaagaagugggaccuguucgucgagcgguccaaggccuacagcaacugcuaccccuacgacgugccggacuacgcgucccugcgcagccucguggccuccagcggcacccuggaguucaacaacgaguccuucaacuggacgggggucacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcgugcaccaccccgggaccgacaaggaccagaucuuccuguacgcgcagagcuccgggcgcaucaccgucagcaccaagcggagccagcaggccgugaucccgaacaucggcucccgcccccggauccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgucaaccggaucaccuacggggccugcccccgcuacgugaagcaguccacgcugaagcucgcgaccggcaugcggaacgugcccgagaagcagacccgcgggaucuucggcgccaucgccggguucaucgagaacggcugggagggcauggucgacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacaucaagugcaacaucugcaucuga

SEQ ID NO: 72680 - RNA, 1701 nt, Artificial Sequence; identical to SEQ ID NO: 70866
  derived and/or modified sequence opt1 from hemagglutinin__InfluenzaA__AHL99117

SEQ ID NO: 72681 - RNA, 1701 nt, Artificial Sequence
  derived and/or modified sequence opt1 from hemagglutinin__InfluenzaA__AHL99129
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggacaucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaucugggccugccagaaggggaacauccgcugcaacaucugcaucuga

SEQ ID NO: 72682 - RNA, 1701 nt, Artificial Sequence
  derived and/or modified sequence opt1 from hemagglutinin__InfluenzaA__AHL99141
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgccggagcaacuccagcuucuucucccgccugaacuggcucacccaccuggacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 72683 - RNA, 1701 nt, Artificial Sequence
  derived and/or modified sequence opt1 from hemagglutinin__InfluenzaA__AHL99153
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaccccgaacaucggcucccggccccgcauccgggacauccccagccgcaucuccaucuacuggacgaucgucaagcccggggacauccugcucaucaacagcaccggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacgcugaagcucgccaccgggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagacgaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 72684 - RNA, 1701 nt, Artificial Sequence; identical to SEQ ID NO: 71005
  derived and/or modified sequence opt1 from hemagglutinin__InfluenzaA__AHL99165

SEQ ID NO: 72685 - RNA, 1701 nt, Artificial Sequence; identical to SEQ ID NO: 71490
  derived and/or modified sequence opt1 from hemagglutinin__InfluenzaA__AHL99177

SEQ ID NO: 72686 - RNA, 1701 nt, Artificial Sequence; identical to SEQ ID NO: 70866
  derived and/or modified sequence opt1 from hemagglutinin__InfluenzaA__AHL99189

SEQ ID NO: 72687 - RNA, 1701 nt, Artificial Sequence; identical to SEQ ID NO: 71002
  derived and/or modified sequence opt1 from hemagglutinin__InfluenzaA__AHL99225

SEQ ID NO: 72688 - RNA, 1701 nt, Artificial Sequence; identical to SEQ ID NO: 71475
  derived and/or modified sequence opt1 from hemagglutinin__InfluenzaA__AHL99237

SEQ ID NO: 72689 - RNA, 1701 nt, Artificial Sequence; identical to SEQ ID NO: 70876
  derived and/or modified sequence opt1 from hemagglutinin__InfluenzaA__AHL99249

SEQ ID NO: 72690 - RNA, 1701 nt, Artificial Sequence; identical to SEQ ID NO: 70866
  derived and/or modified sequence opt1 from hemagglutinin__InfluenzaA__AHL99261

SEQ ID NO: 72691 - RNA, 1701 nt, Artificial Sequence; identical to SEQ ID NO: 71005
  derived and/or modified sequence opt1 from hemagglutinin__InfluenzaA__AHL99273

SEQ ID NO: 72692 - RNA, 1701 nt, Artificial Sequence
  derived and/or modified sequence opt1 from hemagglutinin__InfluenzaA__AHL99285
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccaguccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 72693 - RNA, 1701 nt, Artificial Sequence; identical to SEQ ID NO: 71031
  derived and/or modified sequence opt1 from hemagglutinin__InfluenzaA__AHL99297

SEQ ID NO: 72694 - RNA, 1701 nt, Artificial Sequence; identical to SEQ ID NO: 70876
  derived and/or modified sequence opt1 from hemagglutinin__InfluenzaA__AHL99309

SEQ ID NO: 72695 - RNA, 1701 nt, Artificial Sequence
  derived and/or modified sequence opt1 from hemagglutinin__InfluenzaA__AHL99321
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgccucccugcggagccucgucgcguccagcggcacgcuggaguucaacaacgaguccuucaacugggccggggugacccagaacggcaccagcuccgccugcauccgcgggagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugagcaccaagcggagccagcaggccgugaucccgaacaucggcucccgcccccggauccgcaacauccccagccggaucuccaucuacuggacgaucgucaagcccggggacauccugcucaucaacagcaccggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgccugcccccgcuacgugaagcaguccacgcugaagcucgcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 72696 - RNA, 1701 nt, Artificial Sequence
  derived and/or modified sequence opt1 from hemagglutinin__InfluenzaA__AHL99333
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacaacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 72697 - RNA, 1701 nt, Artificial Sequence
  derived and/or modified sequence opt1 from hemagglutinin__InfluenzaA__AHL99356
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagcaaguacuccaagaaguucaagcccgagaucgccauccggccgaagguccgcgaccaggagggccggaugaacuacuacuggacccugaucgagcccggggacaagaucaccuucgaggcgacgggcaaccucguggugccccgcuacgccuucgccauggagcggaacgccgggagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcgccucgcgacgggccugcggaacgugccgagcauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgagaagaucgacggcgugaagcucgagagcacccggaucuaccagauccuggcgaucuacuccaccguggccagcucccugguccucguggugagccugggggccaucagcuucuggaugugcuccaacggcagccugcagugccgcaucugcaucuga

SEQ ID NO: 72698 - RNA, 1701 nt, Artificial Sequence; identical to SEQ ID NO: 70891
  derived and/or modified sequence opt1 from hemagglutinin__InfluenzaA__AHL99367

SEQ ID NO: 72699 - RNA, 1701 nt, Artificial Sequence
  derived and/or modified sequence opt1 from hemagglutinin__InfluenzaA__AHL99379
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccggcagcgacaacggcacgugcuaccccggggacuucaucgacuacgaggagcugcgggagcagcucuccagcguguccagcuucgagcgcuucgagaucuuccccaagaccuccagcuggcccaaccacgacuccaacaagggcgucaccgccgccugcccgcacgccggggcgaagggcuucuacaagaaccugaucuggcuggugaagaaggggaacagcuaccccaagcucuccaucagcuacaucaacgacaagggcaaggaggugcugguccuguggggcauccaccaccccuccaccacggccgaccagcagagccucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccggcagcgggaucaucaucuccgacacccccgugcacgacugcaacaccacgugccagaccccgaagggcgccaucaacaccagccuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcagcggcuacgccgccgaccugaaguccacccagaacgccaucgacaagaucacgaacaaggugaacagcgucaucgagaagaugaacacccaguucaccgcgguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgccaucuacuccaccgcggccagcucccugguccugguggugagccucggcgccaucuccuucuggaugugcagcaacgggagccugcagugccggaucugcaucuga

SEQ ID NO: 72700 - RNA, 1701 nt, Artificial Sequence; identical to SEQ ID NO: 72692
  derived and/or modified sequence opt1 from hemagglutinin__InfluenzaA__AHL99390

SEQ ID NO: 72701 - RNA, 1701 nt, Artificial Sequence; identical to SEQ ID NO: 70866
  derived and/or modified sequence opt1 from hemagglutinin__InfluenzaA__AHL99402

SEQ ID NO: 72702 - RNA, 1701 nt, Artificial Sequence
  derived and/or modified sequence opt1 from hemagglutinin__InfluenzaA__AHL99426
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaugaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72703 - RNA, 1701 nt, Artificial Sequence
  derived and/or modified sequence opt1 from hemagglutinin__InfluenzaA__AHL99438
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccaguccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 72704 - RNA, 1701 nt, Artificial Sequence; identical to SEQ ID NO: 71002
  derived and/or modified sequence opt1 from hemagglutinin__InfluenzaA__AHL99450

SEQ ID NO: 72705 - RNA, 1701 nt, Artificial Sequence; identical to SEQ ID NO: 71475
  derived and/or modified sequence opt1 from hemagglutinin__InfluenzaA__AHL99462

SEQ ID NO: 72706 - RNA, 1701 nt, Artificial Sequence; identical to SEQ ID NO: 71005
  derived and/or modified sequence opt1 from hemagglutinin__InfluenzaA__AHL99474

SEQ ID NO: 72707 - RNA, 1701 nt, Artificial Sequence; identical to SEQ ID NO: 71031
  derived and/or modified sequence opt1 from hemagglutinin__InfluenzaA__AHL99486

SEQ ID NO: 72708 - RNA, 1701 nt, Artificial Sequence; identical to SEQ ID NO: 71002
  derived and/or modified sequence opt1 from hemagglutinin__InfluenzaA__AHL99498

SEQ ID NO: 72709 - RNA, 1701 nt, Artificial Sequence; identical to SEQ ID NO: 70866
  derived and/or modified sequence opt1 from hemagglutinin__InfluenzaA__AHL99510

SEQ ID NO: 72710 - RNA, 1701 nt, Artificial Sequence; identical to SEQ ID NO: 70866
  derived and/or modified sequence opt1 from hemagglutinin__InfluenzaA__AHL99522

SEQ ID NO: 72711 - RNA, 1701 nt, Artificial Sequence; identical to SEQ ID NO: 70891
  derived and/or modified sequence opt1 from hemagglutinin__InfluenzaA__AHL99534

SEQ ID NO: 72712 - RNA, 1701 nt, Artificial Sequence; identical to SEQ ID NO: 70866
  derived and/or modified sequence opt1 from hemagglutinin__InfluenzaA__AHL99546

SEQ ID NO: 72713 - RNA, 1701 nt, Artificial Sequence; identical to SEQ ID NO: 70866
  derived and/or modified sequence opt1 from hemagglutinin__InfluenzaA__AHL99558

SEQ ID NO: 72714 - RNA, 1701 nt, Artificial Sequence
  derived and/or modified sequence opt1 from hemagglutinin__InfluenzaA__AHL99570
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcuccugcuaccccuacgacgugccggacuacgcgagccugcgcucccucgucgccagcuccggcacccuggaguucaacaacgagagcuucaacuggacgggggugacccagaacggcaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccgugagcaccaagcggucccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacaucaagcagagcacgcugaagcucgcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaaggggguggagcugaaguccggcuacaaggacuggauccuguggaucagcuucgccaucagcugcuuccuccugugcgucgcccugcucggcuucaucaugugggccugccagaaggggaacauccgcugcaacaucugcaucuga

SEQ ID NO: 72715 - RNA, 1701 nt, Artificial Sequence; identical to SEQ ID NO: 70866
  derived and/or modified sequence opt1 from hemagglutinin__InfluenzaA__AHL99582

SEQ ID NO: 72716 - RNA, 1701 nt, Artificial Sequence
  derived and/or modified sequence opt1 from hemagglutinin__InfluenzaA__AHL99594
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccggcagcgacaacggcacgugcuaccccggggacuucaucgacuacgaggagcugcgggagcagcucuccagcguguccagcuucgagcgcuucgagaucuuccccaagaccuccagcuggcccaaccacgacuccaacaagggcgucaccgccgccugcccgcgggccggggcgaagggcuucuacaagaaccugaucuggcuggugaagaaggggaacagcuaccccaagcucuccaucagcuacaucaacgacaagggcaaggaggugcugguccuguggggcauccaccaccccuccaccacggccgaccagcagagccucuaccagaacgccgacaccuacguguucguggggaccagccgcuacuccaagaaguucaagcccgagaucgccauccggccgaagguccgcgaccaggagggccggaugaacuacuacuggacccugguggagcccggggacaagaucacguucgaggccaccggcaaccugguggucccccgcuacgcguucgccauggagcggaacgccggcagcgggaucaucaucuccgacacccccgugcacgacugcaacaccacgugccagaccccgaagggcgccaucaacaccagccuccccuuccagaacauccaccccaucaccaucgggaagugccccaaguacgugaaguccacgaagcugcgccuggccaccggccuccggaacgucccgagcauccagucccgcgggcuguucggcgcgaucgccggcuucaucgagggcggguggaccgggaugguggacggcugguacggguaccaccaccagaacgagcagggcagcggcuacgccgccgaccugaaguccacccagaacgccaucgacaagaucacgaacaaggugaacagcgucaucgagaagaugaacacccaguucaccgcgguggggaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgugaagaaccuguacgagaagguccggaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcuggagagcacccggaucuaccagauccucgccaucuacuccaccgcggccagcucccugguccugguggugagccucggcgccaucuccuucuggaugugcagcaacgggagccugcagugccgcaucugcaucuga

SEQ ID NO: 72717 - RNA, 1701 nt, Artificial Sequence; identical to SEQ ID NO: 71475
  derived and/or modified sequence opt1 from hemagglutinin__InfluenzaA__AHL99605

SEQ ID NO: 72718 - RNA, 1701 nt, Artificial Sequence; identical to SEQ ID NO: 71005
  derived and/or modified sequence opt1 from hemagglutinin__InfluenzaA__AHL99617

SEQ ID NO: 72719 - RNA, 1701 nt, Artificial Sequence; identical to SEQ ID NO: 70866
  derived and/or modified sequence opt1 from hemagglutinin__InfluenzaA__AHL99629

SEQ ID NO: 72720 - RNA, 1701 nt, Artificial Sequence
  derived and/or modified sequence opt1 from hemagglutinin__InfluenzaA__AHL99641
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccguggucccgaacaucggcucccgcccccggauccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgucaagcaguccacgcugaagcucgcgaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacaaccacgacgucuaccgcgacgaggcccucaacaaccgguuccagaucaaggggguggagcucaagagcggcuacaaggacuggauccuguggaucuccuucgccaugagcugcuuccugcugugcguggcccugcucggcuucaucaugugggccugccagaaggggaacauccgcugcaacaucugcaucuga

SEQ ID NO: 72721 - RNA, 1701 nt, Artificial Sequence
  derived and/or modified sequence opt1 from hemagglutinin__InfluenzaA__AHL99665
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacaucaagcaguccacgcugaagcucgcgaccggcaugcggaacgugcccgagaagcagacccgcgggaucuucggcgccaucgccggguucaucgagaacggcugggagggcauggucgacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 72722 - RNA, 1701 nt, Artificial Sequence; identical to SEQ ID NO: 70866
  derived and/or modified sequence opt1 from hemagglutinin__InfluenzaA__AHL99677

SEQ ID NO: 72723 - RNA, 1701 nt, Artificial Sequence; identical to SEQ ID NO: 70866
  derived and/or modified sequence opt1 from hemagglutinin__InfluenzaA__AHL99689

SEQ ID NO: 72724 - RNA, 1701 nt, Artificial Sequence
  derived and/or modified sequence opt1 from hemagglutinin__InfluenzaA__AHL99701
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaccccgaacaucggcucccggccccgcauccggaacauccccagccgcaucuccaucuacuggacgaucgucaagcccggggacauccugcucaucaacagcaccggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacgcugaagcucgccaccgggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagacgaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 72725 - RNA, 1701 nt, Artificial Sequence
  derived and/or modified sequence opt1 from hemagglutinin__InfluenzaA__AHL99713
augaagaccaucaucgcccugagcuacauccucugccugguguucgcccagaagcugcccggcaacgacaacuccaccgcgacccucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacaccucccugcgcagccucgucgcguccagcggcacgcuggaguucaacaacgaguccuucaacuggaccggggugacccagaacggcaccagcuccgccugcauccggcgcagcaacuccagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccagagcuccgggcgcaucaccgugagcacgaagcggagccagcaggcggugaucccgaacaucggcucccgcccccggauccgcaacauccccagccggaucuccaucuacuggaccaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcaguccacccugaagcucgccaccggcaugcggaacguccccgagaagcagacccgcgggaucuucggcgcgaucgccggguucaucgagaacggcugggagggcaugguggacgggugguacggcuuccggcaccagaacagcgaggggcgcggccaggccgccgaccugaaguccacgcaggccgcgaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaagggggucgagcucaagagcggcuacaaggacuggauccuguggaucuccuucgccaucacgugcuuccugcugugcguggcccugcucggcuucaucaugugggccugccagaaggggaacauccgcugcaacaucugcaucuga

SEQ ID NO: 72726 - RNA, 1701 nt, Artificial Sequence; identical to SEQ ID NO: 70866
  derived and/or modified sequence opt1 from hemagglutinin__InfluenzaA__AHL99725

SEQ ID NO: 72727 - RNA, 1701 nt, Artificial Sequence; identical to SEQ ID NO: 71068
  derived and/or modified sequence opt1 from hemagglutinin__InfluenzaA__AHL99737

SEQ ID NO: 72728 - RNA, 1701 nt, Artificial Sequence; identical to SEQ ID NO: 70866
  derived and/or modified sequence opt1 from hemagglutinin__InfluenzaA__AHL99748

SEQ ID NO: 72729 - RNA, 1701 nt, Artificial Sequence; identical to SEQ ID NO: 70866
  derived and/or modified sequence opt1 from hemagglutinin__InfluenzaA__AHL99760

SEQ ID NO: 72730 - RNA, 1701 nt, Artificial Sequence; identical to SEQ ID NO: 70876
  derived and/or modified sequence opt1 from hemagglutinin__InfluenzaA__AHL99772

SEQ ID NO: 72731 - RNA, 1701 nt, Artificial Sequence; identical to SEQ ID NO: 70891
  derived and/or modified sequence opt1 from hemagglutinin__InfluenzaA__AHL99784

SEQ ID NO: 72732 - RNA, 1701 nt, Artificial Sequence; identical to SEQ ID NO: 71031
  derived and/or modified sequence opt1 from hemagglutinin__InfluenzaA__AHL99796

SEQ ID NO: 72733 - RNA, 1701 nt, Artificial Sequence; identical to SEQ ID NO: 70866
  derived and/or modified sequence opt1 from hemagglutinin__InfluenzaA__AHL99808

SEQ ID NO: 72734 - RNA, 1701 nt, Artificial Sequence
  derived and/or modified sequence opt1 from hemagglutinin__InfluenzaA__AHL99820
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgacgggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggugcugcucggcuucaucaugugggccugccagaaggggaacauccgcugcaacaucugcaucuga

SEQ ID NO: 72735 - RNA, 1701 nt, Artificial Sequence; identical to SEQ ID NO: 70866
  derived and/or modified sequence opt1 from hemagglutinin__InfluenzaA__AHL99832

SEQ ID NO: 72736 - RNA, 1701 nt, Artificial Sequence; identical to SEQ ID NO: 70891
  derived and/or modified sequence opt1 from hemagglutinin__InfluenzaA__AHL99844

SEQ ID NO: 72737 - RNA, 1701 nt, Artificial Sequence; identical to SEQ ID NO: 70843
  derived and/or modified sequence opt1 from hemagglutinin__InfluenzaA__AHL99856

SEQ ID NO: 72738 - RNA, 1701 nt, Artificial Sequence
  derived and/or modified sequence opt1 from hemagglutinin__InfluenzaA__AHL99868
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcucaagagcggcuacaaggacuggauccuguggaucuccuucgccaucagcugcuuccugcugugcgucgcgcugcucggcuucaucaugugggccugccagaaggggaacauccgcugcaacaucugcaucuga

SEQ ID NO: 72739 - RNA, 1701 nt, Artificial Sequence; identical to SEQ ID NO: 71005
  derived and/or modified sequence opt1 from hemagglutinin__InfluenzaA__AHL99880

SEQ ID NO: 72740 - RNA, 1701 nt, Artificial Sequence; identical to SEQ ID NO: 70866
  derived and/or modified sequence opt1 from hemagglutinin__InfluenzaA__AHL99892

SEQ ID NO: 72741 - RNA, 1701 nt, Artificial Sequence; identical to SEQ ID NO: 71002
  derived and/or modified sequence opt1 from hemagglutinin__InfluenzaA__AHL99904

SEQ ID NO: 72742 - RNA, 1701 nt, Artificial Sequence
  derived and/or modified sequence opt1 from hemagglutinin__InfluenzaA__AHL99916
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagaugcgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 72743 - RNA, 1701 nt, Artificial Sequence; identical to SEQ ID NO: 70891
  derived and/or modified sequence opt1 from hemagglutinin__InfluenzaA__AHL99928

SEQ ID NO: 72744 - RNA, 1701 nt, Artificial Sequence
  derived and/or modified sequence opt1 from hemagglutinin__InfluenzaA__AHL99940
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcggcguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 72745 - RNA, 1701 nt, Artificial Sequence; identical to SEQ ID NO: 70866
  derived and/or modified sequence opt1 from hemagglutinin__InfluenzaA__AHL99952

SEQ ID NO: 72746 - RNA, 1701 nt, Artificial Sequence; identical to SEQ ID NO: 70891
  derived and/or modified sequence opt1 from hemagglutinin__InfluenzaA__AHL99964

SEQ ID NO: 72747 - RNA, 1701 nt, Artificial Sequence; identical to SEQ ID NO: 70891
  derived and/or modified sequence opt1 from hemagglutinin__InfluenzaA__AHL99976

SEQ ID NO: 72748 - RNA, 1701 nt, Artificial Sequence; identical to SEQ ID NO: 70891
  derived and/or modified sequence opt1 from hemagglutinin__InfluenzaA__AHL99988

SEQ ID NO: 72749 - RNA, 1701 nt, Artificial Sequence; identical to SEQ ID NO: 70866
  derived and/or modified sequence opt1 from hemagglutinin__InfluenzaA__AHM00001

SEQ ID NO: 72750 - RNA, 1701 nt, Artificial Sequence; identical to SEQ ID NO: 70866
  derived and/or modified sequence opt1 from hemagglutinin__InfluenzaA__AHM00013

SEQ ID NO: 72751 - RNA, 1701 nt, Artificial Sequence; identical to SEQ ID NO: 70876
  derived and/or modified sequence opt1 from hemagglutinin__InfluenzaA__AHM00025

SEQ ID NO: 72752 - RNA, 1701 nt, Artificial Sequence; identical to SEQ ID NO: 70891
  derived and/or modified sequence opt1 from hemagglutinin__InfluenzaA__AHM00037

SEQ ID NO: 72753 - RNA, 1701 nt, Artificial Sequence; identical to SEQ ID NO: 70891
  derived and/or modified sequence opt1 from hemagglutinin__InfluenzaA__AHM00061

SEQ ID NO: 72754 - RNA, 1701 nt, Artificial Sequence; identical to SEQ ID NO: 70866
  derived and/or modified sequence opt1 from hemagglutinin__InfluenzaA__AHM00073

SEQ ID NO: 72755 - RNA, 1701 nt, Artificial Sequence; identical to SEQ ID NO: 70866
  derived and/or modified sequence opt1 from hemagglutinin__InfluenzaA__AHM00085

SEQ ID NO: 72756 - RNA, 1701 nt, Artificial Sequence
  derived and/or modified sequence opt1 from hemagglutinin__InfluenzaA__AHM00097
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaacuccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacaccaccgugcacgacugcaacacgaccugccagacccccaagggggccaucaacaccucccugccguuccagaacauccaccccaucacgaucggcaagugccccaaguacgucaagagcaccaagcugcggcucgccaccgggcugcgcaacgugcccuccauccagagccggggccuguucggggcgaucgccggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacaugugcauggaguccgugaagaacggcaccuacgacuacccgaaguacagcgaggaggccaagcugaaccgggagaagaucgacggggugaagcucgaguccacccgcaucuaccagauccuggccaucuacagcacggucgcguccagccuggugcucguggucucccugggcgccaucagcuucuggaugugcagcaacggcucccugcagugccggaucugcaucuga

SEQ ID NO: 72757 - RNA, 1701 nt, Artificial Sequence; identical to SEQ ID NO: 70891
  derived and/or modified sequence opt1 from hemagglutinin__InfluenzaA__AHM00108

SEQ ID NO: 72758 - RNA, 1701 nt, Artificial Sequence; identical to SEQ ID NO: 70891
  derived and/or modified sequence opt1 from hemagglutinin__InfluenzaA__AHM00120

SEQ ID NO: 72759 - RNA, 1701 nt, Artificial Sequence
  derived and/or modified sequence opt1 from hemagglutinin__InfluenzaA__AHM00132
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucagccuguacgcgcaggccuccgggcggaucaccgugagcacgaagcgcagccagcaggccgugaucccgaacaucggcucccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgcgugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 72760 - RNA, 1701 nt, Artificial Sequence; identical to SEQ ID NO: 70866
  derived and/or modified sequence opt1 from hemagglutinin__InfluenzaA__AHM00144

SEQ ID NO: 72761 - RNA, 1701 nt, Artificial Sequence; identical to SEQ ID NO: 70891
  derived and/or modified sequence opt1 from hemagglutinin__InfluenzaA__AHM00156

SEQ ID NO: 72762 - RNA, 1701 nt, Artificial Sequence; identical to SEQ ID NO: 70866
  derived and/or modified sequence opt1 from hemagglutinin__InfluenzaA__AHM00168

SEQ ID NO: 72763 - RNA, 1701 nt, Artificial Sequence
  derived and/or modified sequence opt1 from hemagglutinin__InfluenzaA__AHM00180
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacaacccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacccuggaguucaacaacgagagcuucaacuggacgggggugacccagaacggcaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 72764 - RNA, 1701 nt, Artificial Sequence; identical to SEQ ID NO: 70843
  derived and/or modified sequence opt1 from hemagglutinin__InfluenzaA__AHM00192

SEQ ID NO: 72765 - RNA, 1701 nt, Artificial Sequence; identical to SEQ ID NO: 70891
  derived and/or modified sequence opt1 from hemagglutinin__InfluenzaA__AHM00204

SEQ ID NO: 72766 - RNA, 1701 nt, Artificial Sequence; identical to SEQ ID NO: 70891
  derived and/or modified sequence opt1 from hemagglutinin__InfluenzaA__AHM00216

SEQ ID NO: 72767 - RNA, 1701 nt, Artificial Sequence; identical to SEQ ID NO: 70866
  derived and/or modified sequence opt1 from hemagglutinin__InfluenzaA__AHM00228

SEQ ID NO: 72768 - RNA, 1701 nt, Artificial Sequence; identical to SEQ ID NO: 70866
  derived and/or modified sequence opt1 from hemagglutinin__InfluenzaA__AHM00240

SEQ ID NO: 72769 - RNA, 1701 nt, Artificial Sequence; identical to SEQ ID NO: 70866
  derived and/or modified sequence opt1 from hemagglutinin__InfluenzaA__AHM00252

SEQ ID NO: 72770 - RNA, 1701 nt, Artificial Sequence; identical to SEQ ID NO: 70866
  derived and/or modified sequence opt1 from hemagglutinin__InfluenzaA__AHM00264

SEQ ID NO: 72771 - RNA, 1701 nt, Artificial Sequence; identical to SEQ ID NO: 70843
  derived and/or modified sequence opt1 from hemagglutinin__InfluenzaA__AHM00276

SEQ ID NO: 72772 - RNA, 1701 nt, Artificial Sequence; identical to SEQ ID NO: 70866
  derived and/or modified sequence opt1 from hemagglutinin__InfluenzaA__AHM00288

SEQ ID NO: 72773 - RNA, 1701 nt, Artificial Sequence; identical to SEQ ID NO: 70866
  derived and/or modified sequence opt1 from hemagglutinin__InfluenzaA__AHM00300

SEQ ID NO: 72774 - RNA, 1701 nt, Artificial Sequence; identical to SEQ ID NO: 70891
  derived and/or modified sequence opt1 from hemagglutinin__InfluenzaA__AHM00312

SEQ ID NO: 72775 - RNA, 1701 nt, Artificial Sequence; identical to SEQ ID NO: 70843
  derived and/or modified sequence opt1 from hemagglutinin__InfluenzaA__AHM00324

SEQ ID NO: 72776 - RNA, 1701 nt, Artificial Sequence; identical to SEQ ID NO: 70843
  derived and/or modified sequence opt1 from hemagglutinin__InfluenzaA__AHM00336

SEQ ID NO: 72777 - RNA, 1701 nt, Artificial Sequence; identical to SEQ ID NO: 70891
  derived and/or modified sequence opt1 from hemagglutinin__InfluenzaA__AHM00348

SEQ ID NO: 72778 - RNA, 1701 nt, Artificial Sequence
  derived and/or modified sequence opt1 from hemagglutinin__InfluenzaA__AHM00360
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgccggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 72779 - RNA, 1701 nt, Artificial Sequence; identical to SEQ ID NO: 70891
  derived and/or modified sequence opt1 from hemagglutinin__InfluenzaA__AHM00372

SEQ ID NO: 72780 - RNA, 1701 nt, Artificial Sequence; identical to SEQ ID NO: 70891
  derived and/or modified sequence opt1 from hemagglutinin__InfluenzaA__AHM00395

SEQ ID NO: 72781 - RNA, 1701 nt, Artificial Sequence; identical to SEQ ID NO: 70866
  derived and/or modified sequence opt1 from hemagglutinin__InfluenzaA__AHM00407

SEQ ID NO: 72782 - RNA, 1701 nt, Artificial Sequence; identical to SEQ ID NO: 70866
  derived and/or modified sequence opt1 from hemagglutinin__InfluenzaA__AHM00419

SEQ ID NO: 72783 - RNA, 1701 nt, Artificial Sequence; identical to SEQ ID NO: 70866
  derived and/or modified sequence opt1 from hemagglutinin__InfluenzaA__AHM00443

SEQ ID NO: 72784 - RNA, 1701 nt, Artificial Sequence; identical to SEQ ID NO: 70891
  derived and/or modified sequence opt1 from hemagglutinin__InfluenzaA__AHM00455

SEQ ID NO: 72785 - RNA, 1701 nt, Artificial Sequence; identical to SEQ ID NO: 70891
  derived and/or modified sequence opt1 from hemagglutinin__InfluenzaA__AHM00467

SEQ ID NO: 72786 - RNA, 1701 nt, Artificial Sequence; identical to SEQ ID NO: 70891
  derived and/or modified sequence opt1 from hemagglutinin__InfluenzaA__AHM00479

SEQ ID NO: 72787 - RNA, 1701 nt, Artificial Sequence; identical to SEQ ID NO: 70891
  derived and/or modified sequence opt1 from hemagglutinin__InfluenzaA__AHM00491

SEQ ID NO: 72788 - RNA, 1701 nt, Artificial Sequence; identical to SEQ ID NO: 70866
  derived and/or modified sequence opt1 from hemagglutinin__InfluenzaA__AHM00503

SEQ ID NO: 72789 - RNA, 1701 nt, Artificial Sequence; identical to SEQ ID NO: 70866
  derived and/or modified sequence opt1 from hemagglutinin__InfluenzaA__AHM00515

SEQ ID NO: 72790 - RNA, 1701 nt, Artificial Sequence
  derived and/or modified sequence opt1 from hemagglutinin__InfluenzaA__AHM00527
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagccccaucggggagaucugcgacagcccccaccagauccucgacggcgagaacugcacccugaucgacgcccugcucggggacccccagugcgacggcuuccagaacaagaagugggaccuguucguggagcggagcaaggccuacuccaacugcuacccguacgacgugcccgacuacgcgagccugcgcucccucgucgccagcuccggcacccuggaguucaacaacgagagcuucaacuggacgggggugacccagaacggcaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcguccaccacccggggaccgacaaggaccagaucuuccuguacgcgcaguccagcgggcgcaucaccguguccaccaagcggagccagcaggccgugauccccaacaucggcagccgcccccggauccgcaacauccccucccggaucagcaucuacuggacgaucgucaagccgggcgacauccugcucaucaacuccaccgggaaccugaucgcgccccgcggcuacuucaagauccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcagagcacgcugaagcucgccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacccaggcggccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 72791 - RNA, 1701 nt, Artificial Sequence; identical to SEQ ID NO: 70843
  derived and/or modified sequence opt1 from hemagglutinin__InfluenzaA__AHM00539

SEQ ID NO: 72792 - RNA, 1701 nt, Artificial Sequence
  derived and/or modified sequence opt1 from hemagglutinin__InfluenzaA__AHM00543
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcuccaaggcccacuccaacugcuaccccuacgacgugccggacuacgcgagccugcggucccucgucgccagcuccggcacgauggaguucaacaacgagagcuucaacuggaccggggugacccagaacggcaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcugaucaacuccaccgggaaccucaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcuggccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccucaaguccacgcaggccgccaucgaccagaucaacgggaagcugaaccgccugaucggcaagaccaacgagaaguuccaccagaucgagaaggaguucagcgagguggagggccggauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagagcggcuacaaggacuggauccuguggaucuccuucgccaucagcugcuuccugcucugcgucgcgcugcugggcuucaucaugugggccugccagaaggggaacauccggugcaacaucugcaucuga

SEQ ID NO: 72793 - RNA, 1701 nt, Artificial Sequence; identical to SEQ ID NO: 70866
  derived and/or modified sequence opt1 from hemagglutinin__InfluenzaA__AHM00555

SEQ ID NO: 72794 - RNA, 1701 nt, Artificial Sequence
  derived and/or modified sequence opt1 from hemagglutinin__InfluenzaA__AHM00567
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccgcaagagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 72795 - RNA, 1701 nt, Artificial Sequence; identical to SEQ ID NO: 70866
  derived and/or modified sequence opt1 from hemagglutinin__InfluenzaA__AHM00579

SEQ ID NO: 72796 - RNA, 1701 nt, Artificial Sequence; identical to SEQ ID NO: 70891
  derived and/or modified sequence opt1 from hemagglutinin__InfluenzaA__AHM00591

SEQ ID NO: 72797 - RNA, 1701 nt, Artificial Sequence; identical to SEQ ID NO: 70866
  derived and/or modified sequence opt1 from hemagglutinin__InfluenzaA__AHM00603

SEQ ID NO: 72798 - RNA, 1701 nt, Artificial Sequence; identical to SEQ ID NO: 70866
  derived and/or modified sequence opt1 from hemagglutinin__InfluenzaA__AHM00615

SEQ ID NO: 72799 - RNA, 1701 nt, Artificial Sequence
  derived and/or modified sequence opt1 from hemagglutinin__InfluenzaA__AHM00627
augaagaccaccaucgcccugagcuacauccucugccugguguucgcccagaagcugcccggcaacgacaacuccacggcgacccucugccuggggcaccacgccgucccgaacggcaccaucgugaagaccaucacgaacgaccgcaucgaggugaccaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacgcuggaguucaacaacgaguccuucaacuggaccggggugacccagaacggcaccagcuccgccugcauccggcgcagcaacuccagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcgcaucaccgugagcacgaagcggagccagcaggccgugaucccgaacaucggcucccgcccccggauccgcaacauccccagccggaucuccaucuacuggaccaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcaguccacccugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72800 - RNA, 1701 nt, Artificial Sequence; identical to SEQ ID NO: 70866
  derived and/or modified sequence opt1 from hemagglutinin__InfluenzaA__AHM00639

SEQ ID NO: 72801 - RNA, 1701 nt, Artificial Sequence; identical to SEQ ID NO: 70843
  derived and/or modified sequence opt1 from hemagglutinin__InfluenzaA__AHM00651

SEQ ID NO: 72802 - RNA, 1701 nt, Artificial Sequence; identical to SEQ ID NO: 71002
  derived and/or modified sequence opt1 from hemagglutinin__InfluenzaA__AHM00663

SEQ ID NO: 72803 - RNA, 1701 nt, Artificial Sequence; identical to SEQ ID NO: 70891
  derived and/or modified sequence opt1 from hemagglutinin__InfluenzaA__AHM00675

SEQ ID NO: 72804 - RNA, 1701 nt, Artificial Sequence; identical to SEQ ID NO: 71953
  derived and/or modified sequence opt1 from hemagglutinin__InfluenzaA__AHM00687

SEQ ID NO: 72805 - RNA, 1701 nt, Artificial Sequence
  derived and/or modified sequence opt1 from hemagglutinin__InfluenzaA__AHM00698
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcacgcgccgguccaacaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucacgguguccaccaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 72806 - RNA, 1701 nt, Artificial Sequence; identical to SEQ ID NO: 70866
  derived and/or modified sequence opt1 from hemagglutinin__InfluenzaA__AHM00710

SEQ ID NO: 72807 - RNA, 1701 nt, Artificial Sequence; identical to SEQ ID NO: 70866
  derived and/or modified sequence opt1 from hemagglutinin__InfluenzaA__AHM00722

SEQ ID NO: 72808 - RNA, 1701 nt, Artificial Sequence; identical to SEQ ID NO: 70866
  derived and/or modified sequence opt1 from hemagglutinin__InfluenzaA__AHM00734

SEQ ID NO: 72809 - RNA, 1701 nt, Artificial Sequence; identical to SEQ ID NO: 71001
  derived and/or modified sequence opt1 from hemagglutinin__InfluenzaA__AHM00746

SEQ ID NO: 72810 - RNA, 1701 nt, Artificial Sequence; identical to SEQ ID NO: 70866
  derived and/or modified sequence opt1 from hemagglutinin__InfluenzaA__AHM00758

SEQ ID NO: 72811 - RNA, 1701 nt, Artificial Sequence; identical to SEQ ID NO: 71034
  derived and/or modified sequence opt1 from hemagglutinin__InfluenzaA__AHM00770

SEQ ID NO: 72812 - RNA, 1701 nt, Artificial Sequence; identical to SEQ ID NO: 70843
  derived and/or modified sequence opt1 from hemagglutinin__InfluenzaA__AHM00782

SEQ ID NO: 72813 - RNA, 1701 nt, Artificial Sequence
  derived and/or modified sequence opt1 from hemagglutinin__InfluenzaA__AHM00794
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccgcaucgaggugaccaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgccucccugcgcagccucgucgcguccagcggcacgcuggaguucaacaacgaguccuucaacuggaccggggugacccagaacggcaccagcuccgccugcauccggcgcagcaacuccagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccagagcuccgggcgcaucaccgugagcacgaagcggagccagcaggcggugaucccgaacaucggcucccgcccccggauccgcaacauccccagccggaucuccaucuacuggaccaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcaguccacccugaagcucgccaccggcaugcggaacguccccgagaagcagacccgcgggaucuucggcgcgaucgccggguucaucgagaacggcugggagggcaugguggacgggugguacggcuuccggcaccagaacagcgaggggcgcggccaggccgccgaccugaaguccacgcaggccgcgaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 72814 - RNA, 1701 nt, Artificial Sequence; identical to SEQ ID NO: 71034
  derived and/or modified sequence opt1 from hemagglutinin__InfluenzaA__AHM00806

SEQ ID NO: 72815 - RNA, 1701 nt, Artificial Sequence
  derived and/or modified sequence opt1 from hemagglutinin__InfluenzaA__AHM00818
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgagaacuucaacuggacgggggugacccagaacggcaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 72816 - RNA, 1701 nt, Artificial Sequence; identical to SEQ ID NO: 70891
  derived and/or modified sequence opt1 from hemagglutinin__InfluenzaA__AHM00830

SEQ ID NO: 72817 - RNA, 1701 nt, Artificial Sequence; identical to SEQ ID NO: 70891
  derived and/or modified sequence opt1 from hemagglutinin__InfluenzaA__AHM00842

SEQ ID NO: 72818 - RNA, 1701 nt, Artificial Sequence; identical to SEQ ID NO: 72794
  derived and/or modified sequence opt1 from hemagglutinin__InfluenzaA__AHM00854

SEQ ID NO: 72819 - RNA, 1701 nt, Artificial Sequence; identical to SEQ ID NO: 72794
  derived and/or modified sequence opt1 from hemagglutinin__InfluenzaA__AHM00866

SEQ ID NO: 72820 - RNA, 1701 nt, Artificial Sequence; identical to SEQ ID NO: 70866
  derived and/or modified sequence opt1 from hemagglutinin__InfluenzaA__AHM00878

SEQ ID NO: 72821 - RNA, 1701 nt, Artificial Sequence; identical to SEQ ID NO: 70843
  derived and/or modified sequence opt1 from hemagglutinin__InfluenzaA__AHM00890

SEQ ID NO: 72822 - RNA, 1701 nt, Artificial Sequence; identical to SEQ ID NO: 70876
  derived and/or modified sequence opt1 from hemagglutinin__InfluenzaA__AHM00902

SEQ ID NO: 72823 - RNA, 1701 nt, Artificial Sequence; identical to SEQ ID NO: 70866
  derived and/or modified sequence opt1 from hemagglutinin__InfluenzaA__AHM00914

SEQ ID NO: 72824 - RNA, 1701 nt, Artificial Sequence; identical to SEQ ID NO: 70866
  derived and/or modified sequence opt1 from hemagglutinin__InfluenzaA__AHM00926

SEQ ID NO: 72825 - RNA, 1701 nt, Artificial Sequence; identical to SEQ ID NO: 70843
  derived and/or modified sequence opt1 from hemagglutinin__InfluenzaA__AHM00938

SEQ ID NO: 72826 - RNA, 1701 nt, Artificial Sequence
  derived and/or modified sequence opt1 from hemagglutinin__InfluenzaA__AHM00950
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgucucccugcgcagccucguggcguccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcccagagcuccgggcgcaucaccgugagcaccaagcggagccagcaggcggucaucccgaacaucggcucccgcccccggauccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgucaagcaguccacgcugaagcucgccaccggcaugcggaacgugcccgagaagcagacccgcgggaucuucggcgcgaucgccggguucaucgagaacggcugggagggcaugguggacgggugguacggcuuccggcaccagaacagcgaggggcgcggccaggccgccgaccugaaguccacccaggccgcgaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgccugcaucggguccauccggaacggcaccuacgaccacaacgucuaccgcgacgaggcgcucaacaaccgguuccagaucaaggggguggagcucaagagcggcuacaaggacuggauccuguggaucuccuucgccaugagcugcuuccugcugugcguggcccugcucggcuucaucaugugggccugccagaaggggaacauccgcugcaacaucugcaucuga

SEQ ID NO: 72827 - RNA, 1701 nt, Artificial Sequence; identical to SEQ ID NO: 70843
  derived and/or modified sequence opt1 from hemagglutinin__InfluenzaA__AHM00962

SEQ ID NO: 72828 - RNA, 1701 nt, Artificial Sequence
  derived and/or modified sequence opt1 from hemagglutinin__InfluenzaA__AHM00974
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggggcaucaccguguccacgaagcggagccagcaggccgugaucccgaacaucggcagccgcccccggguccgcaacauccccucccgggugagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcguggagcugaaguccggcuacaaggacuggauccuguggaucuccuucgccaucagcugcuuccuccugugcgucgcgcugcucggguucaucaugugggccugccagaagggcaacauccgcugcaacaucugcaucuga

SEQ ID NO: 72829 - RNA, 1683 nt, Artificial Sequence
  derived and/or modified sequence opt1 from hemagglutinin__InfluenzaA__AHM24224
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaaggaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucaccuucagcuucaacggcgcguucaucgcccccgaccgcgccuccuuccuccggggcaagagcauggggauccaguccggcguccagguggacgccaacugcgagggggacugcuaccacagcggcgggacgaucaucuccaaccugcccuuccagaacaucgacagccgcgccgugggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgcgaucgugauggggcuggucuucaucugcgugaagaacggcaacaugcgcugcaccaucugcaucuga

SEQ ID NO: 72830 - RNA, 1683 nt, Artificial Sequence; identical to SEQ ID NO: 70996
  derived and/or modified sequence opt1 from hemagglutinin__InfluenzaA__AHM24236

SEQ ID NO: 72831 - RNA, 1683 nt, Artificial Sequence; identical to SEQ ID NO: 70996
  derived and/or modified sequence opt1 from hemagglutinin__InfluenzaA__AHM24248

SEQ ID NO: 72832 - RNA, 1701 nt, Artificial Sequence
  derived and/or modified sequence opt1 from hemagglutinin__InfluenzaA__AHM98309
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgaggucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccacggccgaccagcagucccuguaccagaacgccgacgccuacguguucgucggcaccagccgguacuccaagaaguucaagcccgagaucgccauccgcccgaaggugcgggaccaggagggccgcaugaacuacuacuggacccugguggagcccggggacaagaucaccuucgaggcgacgggcaaccucgucgugccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcucccuggugcucgucgugagccugggggccaucagcuucuggaugugcuccaacggcagccugcagugccggaucugcaucuga

SEQ ID NO: 72833 - RNA, 1710 nt, Artificial Sequence
  derived and/or modified sequence opt1 from hemagglutinin__InfluenzaA__AHM98339
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugaccucccugcccuuccagaacauccaccccaucaccaucgggaagugccccaaguacgucaagagcacgaagcuccggcuggcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucacgaacaaggugaacuccgucaucgagaagaugaacacccaguucaccgccgugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacagcaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 72834 - RNA, 1701 nt, Artificial Sequence
  derived and/or modified sequence opt1 from hemagglutinin__InfluenzaA__AHM98350
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacgccaacaagggggucaccgccgccugcccgcacgcgggcgccaagggguucuacaagaaccugaucuggcuggugaagaagggcaacagcuaccccaagcucuccaagagcuacaucaacgacaaggggaaggaggugcugguccuguggggcauccaccaccccuccaccacggccgaccagcagagccucuaccagaacgccgacaccuacguguucgugggcaccagccgguacuccaagaaguucaagcccgagaucgccauccgcccgaagguccgggaccaggaggggcgcaugaacuacuacuggacccugguggagcccggcgacaagaucacguucgaggcgaccgggaaccugguggucccccgguacgccuucgccauggagcgcaacgccggcagcggcaucaucaucuccgacacccccgugcacgacugcaacaccacgugccagaccccgaagggggccaucaacaccagccuccccuuccagaacauccaccccaucaccaucggcaagugccccaaguacgugaaguccacgaagcugcggcuggcgaccgggcuccgcaacgucccgagcauccagucccggggccuguucggggccaucgccggcuucaucgagggcggguggaccggcaugguggacgggugguacggcuaccaccaccagaacgagcaggggagcggcuacgccgccgaccugaaguccacccagaacgcgaucgacaagaucacgaacaaggugaacagcgucaucgagaagaugaacacccaguucaccgccgugggcaaggaguucaaccaccucgagaagcgcaucgagaaccugaacaagaaggucgacgacggguuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagagcacccgcaucuaccagauccucgcgaucuacuccaccgucgccagcucccuggugcugguggucagccucggcgccaucuccuucuggaugugcagcaacggcagccugcagugccggaucugcaucuga

SEQ ID NO: 72835 - RNA, 1701 nt, Artificial Sequence; identical to SEQ ID NO: 67462
  derived and/or modified sequence opt1 from hemagglutinin__InfluenzaA__AHM98361

SEQ ID NO: 72836 - RNA, 1701 nt, Artificial Sequence; identical to SEQ ID NO: 67875
  derived and/or modified sequence opt1 from hemagglutinin__InfluenzaA__AHM98372

SEQ ID NO: 72837 - RNA, 1701 nt, Artificial Sequence; identical to SEQ ID NO: 67875
  derived and/or modified sequence opt1 from hemagglutinin__InfluenzaA__AHM98383

SEQ ID NO: 72838 - RNA, 1701 nt, Artificial Sequence; identical to SEQ ID NO: 67832
  derived and/or modified sequence opt1 from hemagglutinin__InfluenzaA__AHM98394

SEQ ID NO: 72839 - RNA, 1701 nt, Artificial Sequence
  derived and/or modified sequence opt1 from hemagglutinin__InfluenzaA__AHM98405
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucaagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 72840 - RNA, 1701 nt, Artificial Sequence; identical to SEQ ID NO: 72839
  derived and/or modified sequence opt1 from hemagglutinin__InfluenzaA__AHM98416

SEQ ID NO: 72841 - RNA, 1701 nt, Artificial Sequence; identical to SEQ ID NO: 67832
  derived and/or modified sequence opt1 from hemagglutinin__InfluenzaA__AHM98427

SEQ ID NO: 72842 - RNA, 1701 nt, Artificial Sequence; identical to SEQ ID NO: 68050
  derived and/or modified sequence opt1 from hemagglutinin__InfluenzaA__AHM98438

SEQ ID NO: 72843 - RNA, 1701 nt, Artificial Sequence; identical to SEQ ID NO: 69194
  derived and/or modified sequence opt1 from hemagglutinin__InfluenzaA__AHM98449

SEQ ID NO: 72844 - RNA, 1701 nt, Artificial Sequence
  derived and/or modified sequence opt1 from hemagglutinin__InfluenzaA__AHM98460
augaaggccauccuggugguccuccugugcaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacaccaccgugcacgacugcaacacgaccugccagacccccaagggggccaucaacaccucccugccguuccagaacauccaccccaucacgaucggcaagugccccaaguacgucaagagcaccaagcugcggcucgccaccgggcugcgcaacgugcccuccauccagagccggggccuguucggggcgaucgccggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuacccgaaguacagcgaggaggccaagcugaaccgggagaagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 72845 - RNA, 1701 nt, Artificial Sequence; identical to SEQ ID NO: 67875
  derived and/or modified sequence opt1 from hemagglutinin__InfluenzaA__AHM98471

SEQ ID NO: 72846 - RNA, 1701 nt, Artificial Sequence
  derived and/or modified sequence opt1 from hemagglutinin__InfluenzaA__AHM98482
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgacaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 72847 - RNA, 1701 nt, Artificial Sequence
  derived and/or modified sequence opt1 from hemagglutinin__InfluenzaA__AHM98493
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaaguaccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcagccucgugcugguggucucccugggggccaucagcuucuggaugugcuccaacggcagccuccagugccgcaucugcaucuga

SEQ ID NO: 72848 - RNA, 1701 nt, Artificial Sequence
  derived and/or modified sequence opt1 from hemagglutinin__InfluenzaA__AHM98504
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccaaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 72849 - RNA, 1701 nt, Artificial Sequence; identical to SEQ ID NO: 67462
  derived and/or modified sequence opt1 from hemagglutinin__InfluenzaA__AHM98515

SEQ ID NO: 72850 - RNA, 1701 nt, Artificial Sequence
  derived and/or modified sequence opt1 from hemagglutinin__InfluenzaA__AHM98526
augaaggccauccuggugguccuccugcacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccuccgcagcacccagaacgccaucgacaagaucacgaacaaggugaacuccgucaucgagaagaugaacacccaguucaccgcggugggcaaggaguucaaccaccuggagaagcggaucgagaaccugaacaagaaggucgacgacggguuccucgacaucuggaccuacaacgccgagcugcugauccuccuggagaacgagcgcacgcuggacuaccacgacagcaacgugaagaaccucuacgagaaggugcggaaccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgaggagaucgacggggugaagcucgaguccacccggaucuaccagauccuggccaucuacagcaccguggcguccagccugguccucguggugucccugggcgccaucagcuucuggaugugcagcaacggcucccugcagugccgcaucugcaucuga

SEQ ID NO: 72851 - RNA, 1701 nt, Artificial Sequence; identical to SEQ ID NO: 67462
  derived and/or modified sequence opt1 from hemagglutinin__InfluenzaA__AHM98537

SEQ ID NO: 72852 - RNA, 1701 nt, Artificial Sequence
  derived and/or modified sequence opt1 from hemagglutinin__InfluenzaA__AHM98548
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccgugaccaucgggaagugccccaaguacgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcucccuggugcucgucgugagccugggggccaucagcuucuggaugugcuccaacggcagccugcagugccggaucugcaucuga

SEQ ID NO: 72853 - RNA, 1701 nt, Artificial Sequence
  derived and/or modified sequence opt1 from hemagglutinin__InfluenzaA__AHM98559
augaaggccauccuggugguccuccuguacaccuucgccaccgcgaaggccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 72854 - RNA, 1701 nt, Artificial Sequence; identical to SEQ ID NO: 67832
  derived and/or modified sequence opt1 from hemagglutinin__InfluenzaA__AHM98570

SEQ ID NO: 72855 - RNA, 1701 nt, Artificial Sequence
  derived and/or modified sequence opt1 from hemagglutinin__InfluenzaA__AHM98581
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcccggagcugguccuacaucguggagaccagcuccagcgacaacggcacgugcuaccccggcgacuucaucgacuacgaggagcuccgcgagcagcuguccagcguguccagcuucaagcgguucgagaucuuccccaagaccuccagcuggcccaaccacgacuccaacaagggggucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccaccacggccgaccagcagagccuguaccagaacgccgacaccuacguguucgugggcaccagccgcuacuccaagaaguucaagcccgagaucgccauccggccgaagguccgcgaccaggaggggcggaugaacuacuacuggacccugguggagcccggcgacaagaucacguucgaggccaccgggaaccucguggucccccgcuacgcguucgccauggagcggaacgccggcagcggcaucaucaucuccgacacccccgugcacgacugcaacaccacgugccagaccccgaagggggccaucaacaccagccugcccuuccagaacauccaccccaucaccaucggcaagugccccaaguacgugaaguccacgaagcugcgccucgccaccgggcugcggaacgucccgagcauccagucccgcggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucacgaacaaggugaacagcgucaucgagaagaugaacacccaguucaccgcggugggcaaggaguucaaccaccuggagaagcggaucgagaaccugaacaagaaggucgacgacggguuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggccaucuacuccaccgucgcgagcucccuggugcucguggucagccugggcgccaucuccuucuggaugugcagcaacggcagccugcagugccgcaucugcaucuga

SEQ ID NO: 72856 - RNA, 1701 nt, Artificial Sequence; identical to SEQ ID NO: 67832
  derived and/or modified sequence opt1 from hemagglutinin__InfluenzaA__AHM98592

SEQ ID NO: 72857 - RNA, 1701 nt, Artificial Sequence; identical to SEQ ID NO: 67875
  derived and/or modified sequence opt1 from hemagglutinin__InfluenzaA__AHM98603

SEQ ID NO: 72858 - RNA, 1701 nt, Artificial Sequence; identical to SEQ ID NO: 67462
  derived and/or modified sequence opt1 from hemagglutinin__InfluenzaA__AHM98614

SEQ ID NO: 72859 - RNA, 1701 nt, Artificial Sequence; identical to SEQ ID NO: 72839
  derived and/or modified sequence opt1 from hemagglutinin__InfluenzaA__AHM98625

SEQ ID NO: 72860 - RNA, 1701 nt, Artificial Sequence; identical to SEQ ID NO: 72839
  derived and/or modified sequence opt1 from hemagglutinin__InfluenzaA__AHM98636

SEQ ID NO: 72861 - RNA, 1701 nt, Artificial Sequence
  derived and/or modified sequence opt1 from hemagglutinin__InfluenzaA__AHM98647
augaaggccauccuggugguccuccuguacaccuucgccaccgcgaaggccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 72862 - RNA, 1701 nt, Artificial Sequence; identical to SEQ ID NO: 67875
  derived and/or modified sequence opt1 from hemagglutinin__InfluenzaA__AHM98658

SEQ ID NO: 72863 - RNA, 1701 nt, Artificial Sequence; identical to SEQ ID NO: 67832
  derived and/or modified sequence opt1 from hemagglutinin__InfluenzaA__AHM98669

SEQ ID NO: 72864 - RNA, 1701 nt, Artificial Sequence; identical to SEQ ID NO: 69194
  derived and/or modified sequence opt1 from hemagglutinin__InfluenzaA__AHM98701

SEQ ID NO: 72865 - RNA, 1701 nt, Artificial Sequence; identical to SEQ ID NO: 69194
  derived and/or modified sequence opt1 from hemagglutinin__InfluenzaA__AHM98712

SEQ ID NO: 72866 - RNA, 1701 nt, Artificial Sequence
  derived and/or modified sequence opt1 from hemagglutinin__InfluenzaA__AHM98723
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaacugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagauccugcccaagaccagcuccuggcccaaccacgacagcaacaagggggucaccgccgccugcccgcaggccggcgcgaaguccuucuacaagaaccucaucuggcuggugaagaaggggaacagcuaccccaagcuguccaagagcuacaucaacgacaagggcaaggaggugcucguccugugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccucaucgagcccggggacaagaucaccuucgaggcgaccggcaaccugcuggugccccgcuacgccuucgccauggagcggaacgccggguccggcaucaucaucagcgacacgcccguccacgacugcaacacgaccugccagaccccgaagggcgccaucaacaccucccuccccuuccagaacauccaccccaucaccaucgggaagugccccaaguacgucaagagcaccaagcugcgccuggcgaccggccuccggaacgugccguccauccagagccgcgggcuguucggcgccaucgccggguucaucgagggcggcuggacggggaugguggacggcugguacggguaccaccaccagaacgcccagggcuccggguacgccgcggaccucaagagcacccagaacgccaucgacaagaucaccaacaaggugaacuccgugaucgagaagaugaacacccaguucacggccgucggcaaggaguucaaccaccuggagaagcggaucgagaaccugaacaagaagguggacgacggcuuccuggacaucuggaccuacaacgccgagcuccugguccugcucgagaacgagcgcacccuggacuaccacgacagcaacgugaagaaccuguacgagaaggugcggucccagcucaagaacaacgccaaggagaucgggaacggcugcuucgaguucuaccacaagugcgacaacacgugcauggagagcgucaagaacgggaccuacgacuacccccgcuacuccgaggaggcgaagcugaaccgggaggagaucgacggcgugaagcuggagagcacccgcaucuaccagauccucgccaucuacuccaccguggccagcagccugguccugaucgugucccucggggccaucagcuucuggaugugcuccaacggcagccugcagugccggaucugcaucuga

SEQ ID NO: 72867 - RNA, 1701 nt, Artificial Sequence
  derived and/or modified sequence opt1 from hemagglutinin__InfluenzaA__AHM98734
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcaacuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcuccaagggguucuacaagaaccugaucuggcucgugaagaagggcaacagcuaccccaagcuguccaagagcuacaucaacgacaaggggaaggaggugcugguccucuggggcauccaccaccccuccacgaccgcggaccagcagagccuguaccagaacgccgacaccuacguguucgugggcaccagccgguacuccaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgccuucgcgauggagcgcgacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgccaccgggcugcgcaacgucccgagcauccagucccggggccuguucggggccaucgcgggcuucaucgagggcggguggaccggcaugguggacgggugguacggcuaccaccaccagaacgagcaggggagcggcuacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgcggagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgccgcgagcucccugguccucguggugagccugggcgccaucuccuucuggaugugcagcaacggcagccugcagugccggaucugcaucuga

SEQ ID NO: 72868 - RNA, 1701 nt, Artificial Sequence; identical to SEQ ID NO: 69194
  derived and/or modified sequence opt1 from hemagglutinin__InfluenzaA__AHM98745

SEQ ID NO: 72869 - RNA, 1701 nt, Artificial Sequence
  derived and/or modified sequence opt1 from hemagglutinin__InfluenzaA__AHM98756
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacaccuacguguucgugggcaccagccgguacuccaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgcguucgccauggagcgcgacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgccaccgggcugcgcaacgucccgagcauccagucccggggccuguucggggcgaucgccggcuucaucgagggcggguggaccggcaugguggacgggugguacggcuaccaccaccagaacgagcaggggagcggcuacgccgccgaccucaaguccacgcagaacgccaucgacaagaucaccaacaaggugaacagcgucaucgugaagaugaacacccaguucaccgcggucggcaaggaguucaaccaccuggagaagcgcaucgagaaccugaacaagaagguggacgacggguuccucgacaucuggacguacaacgccgagcugcuggugcuccuggagaacgagcggacccuggacuaccacgacuccaacgucaagaaccucuacgagaaggugcgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagagcacccgcaucuaccagauccuggccaucuacuccaccgcggccagcucccuggugcucguggucagccugggcgccaucuccuucuggaugugcagcaacggcagccugcagugccggaucugcaucuga

SEQ ID NO: 72870 - RNA, 1701 nt, Artificial Sequence; identical to SEQ ID NO: 69194
  derived and/or modified sequence opt1 from hemagglutinin__InfluenzaA__AHM98767

SEQ ID NO: 72871 - RNA, 1701 nt, Artificial Sequence
  derived and/or modified sequence opt1 from hemagglutinin__InfluenzaA__AHM98778
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaaccgcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacgggacgugcuaccccggcgacuucaucaacuacgaggagcuccgggagcagcugagcuccgugagcuccuucgagcgguucgagaucuuccccaagaccagcuccuggcccaaccacgacagcaacaagggcgucaccgccgccugcccgcgcgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccacggccgaccagcagucccuguaccagaacgccgacgccuacguguucguggggaccagccgguacuccaagaaguucaagcccgagaucgccauccgcccgaagguccgggaccaggagggccgcaugaacuacuacuggacccugguggagcccggcgacaagaucaccuucgaggcgacggggaaccuccuggugccccgguacgccuucgccauggagcgcaacgccggcagcgggaucaucaucuccgacacccccguccacgacugcaacacgaccugccagaccccgaagggcgccaucaacaccagccugcccuuccagaacauccaccccaucaccaucggcaagugccccaaguacgugaaguccaccaagcuccggcuggcgacggggcugcgcaacgugccgagcauccagucccggggccucuucggggccaucgccggcuucaucgagggcggguggaccggcauggucgacgggugguacggcuaccaccaccagaacgagcaggggagcggcuacgccgccgaccugaaguccacccagaacgcgaucgacaagaucaccaacaaggugaacagcgugaucgagaagaugaacacgcaguucaccgccgucgggaaggaguucaaccaccuggagaagcgcaucgagaaccucaacaagaagguggacgacggcuuccuggacaucuggaccuacaacgccgagcugcucguccugcuggagaacgagcggacccucgacuaccacgacuccaacgugaagaaccuguacgagaaggugcgcaaccagcugaagaacaacgccaaggagaucggcaacgggugcuucgaguucuaccacaagugcgacaacacgugcauggagagcgucaagaacggcaccuacgacuaccccaaguacuccgaggaggccaagcucaaccgggaggagaucgacggggugaagcuggagagcacccgcaucuaccagauccuggcgaucuacuccaccguggccagcucccucguccugguggugagccugggcgccaucagcuucuggaugugcuccaacgggagccuccagugccggaucugcaucuga

SEQ ID NO: 72872 - RNA, 1701 nt, Artificial Sequence; identical to SEQ ID NO: 68058
  derived and/or modified sequence opt1 from hemagglutinin__InfluenzaA__AHM98798

SEQ ID NO: 72873 - RNA, 1701 nt, Artificial Sequence; identical to SEQ ID NO: 67832
  derived and/or modified sequence opt1 from hemagglutinin__InfluenzaA__AHM98809

SEQ ID NO: 72874 - RNA, 1701 nt, Artificial Sequence; identical to SEQ ID NO: 67832
  derived and/or modified sequence opt1 from hemagglutinin__InfluenzaA__AHM98820

SEQ ID NO: 72875 - RNA, 1701 nt, Artificial Sequence; identical to SEQ ID NO: 67832
  derived and/or modified sequence opt1 from hemagglutinin__InfluenzaA__AHM98831

SEQ ID NO: 72876 - RNA, 1701 nt, Artificial Sequence
  derived and/or modified sequence opt1 from hemagglutinin__InfluenzaA__AHM98836
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccacggccgaccagcagagccucuaccagaacgccgacaccuacguguucgugggcaccucccgguacagcaagaaguucaagcccgagaucgccauccgcccgaagguccgggaccaggaggggcgcaugaacuacuacuggauccugguggagcccggcgacaagaucaccuucgaggccacggggaaccugguggucccccgguacgcguucgccauggagcgcaacgccggcuccggcaucaucaucagcgacacccccgugcacgacugcaacacgaccugccagaccccgaagggggccaucaacaccucccuccccuuccagaacauccaccccaucaccaucggcaagugccccaaguacgucaagagcaccaagcugcggcuggccacggggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacccuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcguccagccuggugcugguggucucccucggcgccaucagcuucuggaugugcagcaacggcucccugcagugccggaucugcaucuga

SEQ ID NO: 72877 - RNA, 1701 nt, Artificial Sequence
  derived and/or modified sequence opt1 from hemagglutinin__InfluenzaA__AHM98847
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacgacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccacggccgaccagcagagccucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcguccagccuggugcugguggucucccucggcgccaucagcuucuggaugugcagcaacggcucccugcagugccggaucugcaucuga

SEQ ID NO: 72878 - RNA, 1701 nt, Artificial Sequence; identical to SEQ ID NO: 67832
  derived and/or modified sequence opt1 from hemagglutinin__InfluenzaA__AHM98858

SEQ ID NO: 72879 - RNA, 1701 nt, Artificial Sequence; identical to SEQ ID NO: 67875
  derived and/or modified sequence opt1 from hemagglutinin__InfluenzaA__AHM98877

SEQ ID NO: 72880 - RNA, 1701 nt, Artificial Sequence
  derived and/or modified sequence opt1 from hemagglutinin__InfluenzaA__AHM98898
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaaccacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 72881 - RNA, 1701 nt, Artificial Sequence; identical to SEQ ID NO: 71458
  derived and/or modified sequence opt1 from hemagglutinin__InfluenzaA__AHM98909

SEQ ID NO: 72882 - RNA, 1701 nt, Artificial Sequence
  derived and/or modified sequence opt1 from hemagglutinin__InfluenzaA__AHM98932
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgcgagcagcugagcuccgugagcuccuucgagcgguucgagaucuuccccaagaccagcuccuggcccaaccacgacagcaacaagggcgucaccgccgccugcccgcacgccggggcgaaguccuucuacaagaaccugaucuggcucgugaagaagggcgacagcuaccccaagcuguccaagagcuacaucaacgacaaggggaaggaggugcugguccucuggggcauccaccaccccagcaccuccgccgaccagcagagccuguaccagaacgccgacgccuacguguucgugggcuccagccgcuacuccaagaaguucaagcccgagaucgccauccggccgaagguccgcgaccgggaggggcgcaugaacuacuacuggacgcugguggagcccggcgacaagaucaccuucgaggcgaccgggaaccucguggucccccgguacgccuucgccauggagcgcaacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 72883 - RNA, 1701 nt, Artificial Sequence; identical to SEQ ID NO: 72882
  derived and/or modified sequence opt1 from hemagglutinin__InfluenzaA__AHM98940

SEQ ID NO: 72884 - RNA, 1701 nt, Artificial Sequence; identical to SEQ ID NO: 72882
  derived and/or modified sequence opt1 from hemagglutinin__InfluenzaA__AHM98951

SEQ ID NO: 72885 - RNA, 1701 nt, Artificial Sequence
  derived and/or modified sequence opt1 from hemagglutinin__InfluenzaA__AHM98975
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgagagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 72886 - RNA, 1701 nt, Artificial Sequence
  derived and/or modified sequence opt1 from hemagglutinin__InfluenzaA__AHM98997
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaagggggacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 72887 - RNA, 1701 nt, Artificial Sequence
  derived and/or modified sequence opt1 from hemagglutinin__InfluenzaA__AHM99019
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaagggggacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcggccaggaggggcggaugaacuacuacuggacgcugguggagcccggcgacaagaucaccuucgaggcgaccgggaaccucguggucccccgcuacgccuucgccauggagcggaacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcgccucgcgaccgggcugcggaacgucccgagcauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggguuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccagcucccuggugcucguggucagccugggcgccaucuccuucuggaugugcagcaacggcucccugcagugccgcaucugcaucuga

SEQ ID NO: 72888 - RNA, 1701 nt, Artificial Sequence; identical to SEQ ID NO: 72887
  derived and/or modified sequence opt1 from hemagglutinin__InfluenzaA__AHM99031

SEQ ID NO: 72889 - RNA, 1701 nt, Artificial Sequence; identical to SEQ ID NO: 72887
  derived and/or modified sequence opt1 from hemagglutinin__InfluenzaA__AHM99043

SEQ ID NO: 72890 - RNA, 1701 nt, Artificial Sequence; identical to SEQ ID NO: 72887
  derived and/or modified sequence opt1 from hemagglutinin__InfluenzaA__AHM99054

SEQ ID NO: 72891 - RNA, 1701 nt, Artificial Sequence; identical to SEQ ID NO: 72887
  derived and/or modified sequence opt1 from hemagglutinin__InfluenzaA__AHM99065

SEQ ID NO: 72892 - RNA, 1701 nt, Artificial Sequence
  derived and/or modified sequence opt1 from hemagglutinin__InfluenzaA__AHM99075
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaagggggacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 72893 - RNA, 1701 nt, Artificial Sequence
  derived and/or modified sequence opt1 from hemagglutinin__InfluenzaA__AHN00717
augaaggccauccugcucgugcugcugugcaccuucgccgcgaccaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugggcgggaucgcgccccuccaccugggcaagugcaacaucgccggguggcugcucggcaacccggagugcgagcugcuguucaccgugagcuccuggagcuacaucgucgagaccuccaacagcgacaacggcacgugcuaccccggggacuucaucaacuacgaggagcuccgggagcagcuguccagcguguccagcuucgagcgcuucgagaucuuccccaagaccuccagcuggcccaaccacgagaccaaccggggcgugaccgccgccugcccguacgccggggccaacuccuucuaccgcaaccugaucuggcucgucaagaagggcaacagcuaccccaagcuguccaagagcuacgugaacaacaaggggaaggaggugcugguccucuggggcauccaccacccgcccacguccaccgaccagcagagccuguaccagaacgcggacgccuacguguucgugggcuccagcaaguacaaccggaaguucaagcccgagaucgccgcccgccccaagguccgggggcaggccggccgcaugaacuacuacuggacccugaucgagcccggggacaccaucacguucgaggcgaccggcaaccucguggugccccgguacgccuucgccaugaaccgcggcccggggagcggcaucaucaucuccgacgcccccguccacgacugcaacacgaccugccagacccccaagggggccaucaacaccagccugcccuuccagaacauccacccggugaccaucggcgagugccccaaguacgugaaguccaccaagcugcggauggcgacggggcuccgcaacauccccagcauccagucccggggccuguucggcgccaucgccggguucaucgagggcggguggaccggcaugaucgacgggugguacggcuaccaccaccagaacgagcagggcagcggguacgccgccgaccagaaguccacccagaacgcgaucgacggcaucaccaacaaggucaacagcgugaucaagaagaugaacacgcaguucaccgccguggggaaggaguucaaccaccuggagaagcgcaucgagaaccucaacaagaaggucgacgacggcuuccuggacguguggaccuacaacgccgagcugcucguccugcuggagaacgagcggacccucgacuuccacgacuccaacgugaagaaccuguacgagaaggugcgcagccagcugcggaacaacgccaaggagaucgggaacggcugcuucgaguucuaccacaagugcgacgacacgugcauggaguccgucaagaacggcaccuacgacuaccccaaguacagcgaggaguccaagcucaaccgcgaggagaucgacggggugaagcuggagagcacccggaucuaccagauccuggccaucuacuccaccgcggccagcucccucgugcugcuggucagccucggcgccaucuccuucuggaugugcagcaacgggagccugcagugccgcaucugcaucuga

SEQ ID NO: 72894 - RNA, 1701 nt, Artificial Sequence
  derived and/or modified sequence opt1 from hemagglutinin__InfluenzaA__AHN00764
augaaggccauccugcucgugcugcugugcaccuucgccgcgaccaacgccgacacgcucugcaucggcuaccacgccaacaacagcaccgacaccgucgacaccgugcuggagaagaacgugacggucacccacuccgugaaccugcucgaggacaagcacaacgggaagcugugcaagcugggcgggaucgcgccccuccaccugggcaagugcaacaucgccggguggcugcucggcaacccggagugcgagcugcuguucaccgugagcuccuggagcuacaucgucgagaccuccaacagcgacaacggcacgugcuaccccggggacuucaucaacuacgaggagcuccgcgagcagcuguccagcguguccagcuucgagcgguucgagaucuuccccaagaccuccagcuggcccaaccacgagaccaaccgcggcgugaccgccgccugcccguacgccggggccaacuccuucuaccggaaccugaucuggcucgucaagaagggcaacagcuaccccaagcuguccaagagcuacgugaacaacaaggggaaggaggugcugguccucuggggcauccaccacccgcccacguccaccgaccagcagagccuguaccagaacgcggacgccuacguguucgugggcuccagcaaguacaaccgcaaguucaagcccgagaucgccgcccggcccaagguccgcgggcaggccggccggaugaacuacuacuggacccugaucgagcccggggacaccaucacguucgaggcgaccggcaaccucguggugccccgcuacgccuucgccaugaaccggggcccggggagcggcaucaucaucuccgacgcccccguccacgacugcaacacgaccugccagacccccaagggggccaucaacaccagccugcccuuccagaacauccacccggugaccaucggcgagugccccaaguacgugaaguccaccaagcugcgcauggcgacggggcuccggaacauccccagcauccagucccgcggccuguucggcgccaucgccggguucaucgagggcggguggaccggcaugaucgacgggugguacggcuaccaccaccagaacgagcagggcagcggguacgccgccgaccagaaguccacccagaacgcgaucgacggcaucaccaacaaggucaacagcgugaucaagaagaugaacacgcaguucaccgccguggggaaggaguucaaccaccuggagaagcggaucgagaaccucaacaagaaggucgacgacggcuuccuggacguguggaccuacaacgccgagcugcucguccugcuggagaacgagcgcacccucgacuuccacgacuccaacgugaagaaccuguacgagaaggugcggagccagcugcgcaacaacgccaaggagaucgggaacggcugcuucgaguucuaccacaagugcgacgacacgugcauggaguccgucaagaacggcaccuacgacuaccccaaguacagcgaggaguccaagcucaaccgggaggagaucgacggggugaagcuggagagcacccgcaucuaccagauccuggccaucuacuccaccgcggccagcucccucgugcugcuggucagccucggcgccaucuccuucuggaugugcagcaacgggagccugcagugccggaucugcaucuga

SEQ ID NO: 72895 - RNA, 1683 nt, Artificial Sequence
  derived and/or modified sequence opt1 from hemagglutinin__InfluenzaA__AHN96323
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucaccuucagcuucaacggcgcguucaucgcccccgaccgcgccuccuuccuccggggcaagagcauggggauccaguccggcguccagguggacgccaacugcgagggggacugcuaccacagcggcgggacgaucaucuccaaccugcccuuccagaacaucgacagccgcgccgugggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgcgaucgugauggggcuggucuucaucugcgugaagaacggcaacaugcgcugcaccaucgggaucuga

SEQ ID NO: 72896 - RNA, 1701 nt, Artificial Sequence; identical to SEQ ID NO: 67990
  derived and/or modified sequence opt1 from hemagglutinin__InfluenzaA__AHN96442

SEQ ID NO: 72897 - RNA, 1701 nt, Artificial Sequence
  derived and/or modified sequence opt1 from hemagglutinin__InfluenzaA__AHN96443
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacacgagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcgagcgggcggaucacgguguccaccaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgccugcaucacgcccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 72898 - RNA, 1701 nt, Artificial Sequence
  derived and/or modified sequence opt1 from hemagglutinin__InfluenzaA__AHN96444
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaaccagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaaggggaucgagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 72899 - RNA, 1701 nt, Artificial Sequence
  derived and/or modified sequence opt1 from hemagglutinin__InfluenzaA__AHN96445
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaaccagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccugagcgggaaguccagcaucaugcgguccgacgcccccaucggcaagugcaagagcgagugcaucacccccaacggcuccauccccaacgacaagccguuccagaacgugaaccgcaucaccuacggggccugcccccgguacgugaagcagagcacgcucaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcguggcccuccugggcuucaucaugugggccugccagaaggggaacauccggugcaacaucugcaucuga

SEQ ID NO: 72900 - RNA, 1701 nt, Artificial Sequence
  derived and/or modified sequence opt1 from hemagglutinin__InfluenzaA__AHN96447
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggugcugcucggguucaucaugugggccugccagaagggcaacauccggugcaacaucugcaucuga

SEQ ID NO: 72901 - RNA, 1701 nt, Artificial Sequence
  derived and/or modified sequence opt1 from hemagglutinin__InfluenzaA__AHV83765
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaccaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 72902 - RNA, 1701 nt, Artificial Sequence; identical to SEQ ID NO: 72029
  derived and/or modified sequence opt1 from hemagglutinin__InfluenzaA__AHV83766

SEQ ID NO: 72903 - RNA, 1701 nt, Artificial Sequence; identical to SEQ ID NO: 71048
  derived and/or modified sequence opt1 from hemagglutinin__InfluenzaA__AHV83767

SEQ ID NO: 72904 - RNA, 1701 nt, Artificial Sequence
  derived and/or modified sequence opt1 from hemagglutinin__InfluenzaA__AHV83768
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugcucgagcccggggacaagaucacguucgaggccaccggcaaccugguggugccccgguacgcguucaccauggagcgcaacgccgggagcggcaucaucaucuccgacacccccguccacgacugcaacacgaccugccagaccccggagggcgccaucaacaccagccugcccuuccagaacauccaccccaucacgaucgggaagugccccaaguacgugaaguccaccaagcuccggcuggccaccggccugcgcaacgugccgagcauccagucccggggccucuucggcgccaucgcgggguucaucgagggcggcuggaccgggauggucgacggcugguacggguaccaccaccagaacgagcagggcagcggguacgccgccgaccugaaguccacgcagaacgccaucgacaagaucaccaacaaggugaacagcgugaucgagaagaugaacacccaguucaccgccgucggcaaggaguucaaccaccuggagaagcgcaucgagaaccucaacaagaagguggacgacggcuuccuggacaucuggacguacaacgcggagcugcucguccugcuggagaacgagcggacccucgacuaccacgacuccaacgugaagaaccuguacgagaaggugcgcaaccagcugaagaacaacgccaaggagaucgggaacggcugcuucgaguucuaccacaagugcgacaacacgugcauggacagcgucaagaacgggaccuacgacuaccccaaguacuccgaggaggccaagcucaaccgggagaagaucgacggcgugaagcuggagagcacccgcaucuaccagauccuggccaucuacuccaccguggccagcucccucguccugguggugagccugggggcgaucagcuucuggaugugcuccaacggcagccuccagugccggaucugcaucuga

SEQ ID NO: 72905 - RNA, 1701 nt, Artificial Sequence; identical to SEQ ID NO: 72006
  derived and/or modified sequence opt1 from hemagglutinin__InfluenzaA__AHV83770

SEQ ID NO: 72906 - RNA, 1701 nt, Artificial Sequence
  derived and/or modified sequence opt1 from hemagglutinin__InfluenzaA__AHV83771
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacgaccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccagaaguccacgcagaacgccaucgacaagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgcggagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgccaucuacuccaccgucgccagcucccuggugcugguggucagccucggggcgaucagcuucuggaugugcuccaacggcagccugcagugccggaucugcaucuga

SEQ ID NO: 72907 - RNA, 1701 nt, Artificial Sequence; identical to SEQ ID NO: 71048
  derived and/or modified sequence opt1 from hemagglutinin__InfluenzaA__AHV83772

SEQ ID NO: 72908 - RNA, 1701 nt, Artificial Sequence; identical to SEQ ID NO: 71048
  derived and/or modified sequence opt1 from hemagglutinin__InfluenzaA__AHV83773

SEQ ID NO: 72909 - RNA, 1701 nt, Artificial Sequence; identical to SEQ ID NO: 71048
  derived and/or modified sequence opt1 from hemagglutinin__InfluenzaA__AHV83774

SEQ ID NO: 72910 - RNA, 1701 nt, Artificial Sequence
  derived and/or modified sequence opt1 from hemagglutinin__InfluenzaA__AHV83775
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacaucccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 72911 - RNA, 1701 nt, Artificial Sequence; identical to SEQ ID NO: 71048
  derived and/or modified sequence opt1 from hemagglutinin__InfluenzaA__AHV83776

SEQ ID NO: 72912 - RNA, 1701 nt, Artificial Sequence
  derived and/or modified sequence opt1 from hemagglutinin__InfluenzaA__AHV83777
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacaucccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucugcuucuggaugugcagcaacggcucccugcagugccggaucugcaucuga

SEQ ID NO: 72913 - RNA, 1701 nt, Artificial Sequence
  derived and/or modified sequence opt1 from hemagglutinin__InfluenzaA__AHV83778
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccguguacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 72914 - RNA, 1701 nt, Artificial Sequence
  derived and/or modified sequence opt1 from hemagglutinin__InfluenzaA__AHV83779
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 72915 - RNA, 1701 nt, Artificial Sequence
  derived and/or modified sequence opt1 from hemagglutinin__InfluenzaA__AHV83780
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugcggcaguccuacaucaacgacaagggcaaggaggugcugguccucugggggauccaccaccccagcaccacgaccgaccagcagagccuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucacguucgaggccaccggcaaccucguggucccccgcuacgcguucaccauggagcggaacgccggguccggcaucaucaucagcgacacccccgugcacgacugcaacacgaccugccagaccccggagggcgccaucaacaccucccugcccuuccagaacauccaccccaucacgaucgggaagugccccaaguacgucaagagcaccaagcugcgccucgccaccggccugcggaacgugccguccauccagagccgcgggcuguucggcgccaucgcgggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgcggagcugcuggugcuccuggagaacgagcgcacccuggacuaccacgacagcaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgagaagaucgacggcgugaagcucgaguccacccggaucuaccagauccuggccaucuacagcaccgucgccuccagccuggugcucguggucucccugggggcgaucagcuucuggaugugcagcaacggcucccugcagugccgcaucugcaucuga

SEQ ID NO: 72916 - RNA, 1701 nt, Artificial Sequence; identical to SEQ ID NO: 71048
  derived and/or modified sequence opt1 from hemagglutinin__InfluenzaA__AHV83781

SEQ ID NO: 72917 - RNA, 1701 nt, Artificial Sequence
  derived and/or modified sequence opt1 from hemagglutinin__InfluenzaA__AHV83782
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucaacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcugucccagagcuacaucaacgacaagggcaaggaggugcucguccugugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccucguggagcccggggacaagaucaccuucgaggcgacgggcaaccugguggcgccccgguacgccuucaccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcuccggcuggccaccggccugcgcaacgugccgagcauccagucccggggccucuucggggccaucgccggguucaucgagggcggcuggaccgggauggucgacggcugguacggguaccaccaccagaacgagcagggcagcggguacgccgccgaccugaaguccacccagaacgcgaucgacaagaucacgaacaaggugaacagcgugaucgagaagaugaacacccaguucaccgccgucggcaaggaguucaaccaccuggagaagcgcaucgagaaccucaacaagaagguggacgacggcuuccuggacaucuggaccuacaacgccgagcugcucguccugcuggagaacgagcggacgcucgacuaccacgacuccaacgugaagaaccuguacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggagaagaucgacggcgugaagcuggagagcacccgcaucuaccagauccuggcgaucuacuccaccguggccagcucccucguccugguggugagccugggggccaucagcuucuggaugugcuccaacggcagccuccagugccggaucugcaucuga

SEQ ID NO: 72918 - RNA, 1701 nt, Artificial Sequence
  derived and/or modified sequence opt1 from hemagglutinin__InfluenzaA__AHV83783
augaaggccauccuggugguccuccuguacaccuucgccaccgcgaacgccgacacgcugugcaucggcuaccacgccaacaacagcaccgacaccguggacaccgugcucgagaagaacaucacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaagggguucuacaagaaccugaucuggcucgucaagaagggcaacuccuaccccaagcugcggcagagcuacaucaacgacaaggggaaggaggugcuggugcucuggggcauccaccaccccuccaccacgaccgaccagcagagccuguaccagaacgccgacgccuacgucuucgugggcaccagccgcuacuccaagaaguucaagcccgagaucgccauccggccgaaggugcgcgaccaggaggggcggaugaacuacuacuggacccuggucgagcccggcgacaagaucacguucgaggccaccgggaaccucguggugccccgcuacgcguucaccauggagcggaacgccggcagcggcaucaucaucuccgacacccccguccacgacugcaacacgaccugccagaccccggagggggccaucaacaccagccugcccuuccagaacauccaccccaucacgaucggcaagugccccaaguacgugaaguccaccaagcugcgccucgccaccgggcugcggaacgugccgagcauccagucccgcggccuguucggggccaucgcgggcuucaucgagggcggguggaccggcauggucgacgggugguacggcuaccaccaccagaacgagcaggggagcggcuacgccgccgaccucaaguccacgcagaacgccaucgacaagaucaccaacaaggugaacagcgugaucgagaagaugaacacccaguucaccgccgucggcaaggaguucaaccaccuggagaagcggaucgagaaccugaacaagaagguggacgacggguuccucgacaucuggacguacaacgcggagcugcugguccuccuggagaacgagcgcacccuggacuaccacgacuccaacgugaagaaccucuacgagaaggugcggaaccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgcgagaagaucgacggggugaagcucgagagcacccggaucuaccagauccuggccaucuacuccaccguggccagcucccugguccucguggugagccugggcgcgaucuccuucuggaugugcagcaacggcagccugcagugccgcaucugcaucuga

SEQ ID NO: 72919 - RNA, 1701 nt, Artificial Sequence; identical to SEQ ID NO: 71048
  derived and/or modified sequence opt1 from hemagglutinin__InfluenzaA__AHV83784

SEQ ID NO: 72920 - RNA, 1701 nt, Artificial Sequence; identical to SEQ ID NO: 71048
  derived and/or modified sequence opt1 from hemagglutinin__InfluenzaA__AHV83785

SEQ ID NO: 72921 - RNA, 1701 nt, Artificial Sequence; identical to SEQ ID NO: 71048
  derived and/or modified sequence opt1 from hemagglutinin__InfluenzaA__AHV83787

SEQ ID NO: 72922 - RNA, 1701 nt, Artificial Sequence
  derived and/or modified sequence opt1 from hemagglutinin__InfluenzaA__AHV83788
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucagcccccugcaccucgggaagugcaacaucgccggcuggauccuggggaacccggagugcgagucccugagcaccgccuccagcugguccuacaucguggagaccagcuccagcgacaacggcacgugcuaccccggcgacuucgugaacuacgaggagcuccgggagcagcuguccagcgucuccagcuucgagcgcuucgagaucuuccccaagaccuccagcuggcccaaccacgacuccaacaagggggugaccgcggccugcccgcacgccggcgccaagagcuucuacaagaaccugaucuggcucgugaagaaggggaacuccuaccccaagcugagccagagcuacaucaacgacaagggcaaggagguccuggugcucugggggauccaccaccccuccaccacggcggaccagcagagccuguaccagaacgccgacgccuacguguucgucggcaccucccgguacagcaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucaccauggagcgcaacgccggguccggcaucaucaucagcgacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggucaacuccgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacagcaacgucaagaaccucuacgagaaggugcgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgucaagcucgaguccacccgcaucuaccagauccuggccaucuacagcaccguggccuccagccuggugcucgucgugagccugggggcgaucuccuucuggaugugcagcaacggcucccugcagugccggaucugcaucuga

SEQ ID NO: 72923 - RNA, 1701 nt, Artificial Sequence; identical to SEQ ID NO: 72910
  derived and/or modified sequence opt1 from hemagglutinin__InfluenzaA__AHV83789

SEQ ID NO: 72924 - RNA, 1701 nt, Artificial Sequence; identical to SEQ ID NO: 71048
  derived and/or modified sequence opt1 from hemagglutinin__InfluenzaA__AHV83790

SEQ ID NO: 72925 - RNA, 1701 nt, Artificial Sequence; identical to SEQ ID NO: 71048
  derived and/or modified sequence opt1 from hemagglutinin__InfluenzaA__AHV83791

SEQ ID NO: 72926 - RNA, 1701 nt, Artificial Sequence; identical to SEQ ID NO: 71048
  derived and/or modified sequence opt1 from hemagglutinin__InfluenzaA__AHV83792

SEQ ID NO: 72927 - RNA, 1701 nt, Artificial Sequence
  derived and/or modified sequence opt1 from hemagglutinin__InfluenzaA__AHV83793
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagaaguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggagauccuggugcucugggggauccaccaccccagcaccacggccgaccagcagucccuguaccagaacgccgacgccuacgucuucgugggcaccagccgcuacuccaagaaguucaagcccgagaucgccauccggccgaaggugcgcgaccaggagggccggaugaacuacuacuggacccuggucgagcccggggacaagaucaccuucgaggcgacgggcaaccucguggugccccgcuacgccuucaccauggagcggaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcgccucgccaccggccugcggaacgugccgagcauccagucccgcgggcuguucggcgcgaucgccggguucaucgagggcggcuggaccgggauggucgacggcugguacggguaccaccaccagaacgagcagggcagcggguacgccgccgaccagaaguccacccagaacgccaucgacaagaucacgaacaaggugaacagcgugaucgagaagaugaacacccaguucaccgcggucggcaaggaguucaaccaccucgagaagcggaucgagaaccugaacaagaagguggacgacggcuuccuggacaucuggaccuacaacgccgagcuccugguccugcucgagaacgagcgcacgcuggacuaccacgacuccaacgugaagaaccuguacgagaaggugcggaaccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgcgagaagaucgacggcgugaagcuggagagcacccggaucuaccagauccucgccaucuacuccaccguggcgagcucccugguccugguggugagccucggggccaucagcuucuggaugugcuccaacggcagccugcagugccgcaucugcaucuga

SEQ ID NO: 72928 - RNA, 1701 nt, Artificial Sequence
  derived and/or modified sequence opt1 from hemagglutinin__InfluenzaA__AHV83794
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccagaaguccacccagaacgccaucgacaagaucacgaacaaggugaacagcgucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgccaucuacuccaccgucgcgagcucccuggugcugguggucagccucggggccaucagcuucuggaugugcuccaacggcagccugcagugccggaucugcaucuga

SEQ ID NO: 72929 - RNA, 1701 nt, Artificial Sequence
  derived and/or modified sequence opt1 from hemagglutinin__InfluenzaA__AHV83795
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccgccgccagcuccuggagcuacaucguggagaccuccagcuccgacaacgggaccugcuaccccggcgacuucaucaacuacgaggagcuccgggagcagcugagcuccgugagcuccuucgagcgcuucgagaucuuccccaagacgagcuccuggcccaaccacgacagcaacaagggcgucaccgccgccugcccgcacgcgggcgccaaguccuucuacaagaaccugaucuggcucgugaagaaggggaacagcuaccccaagcugucccagagcuacaucaacgacaagggcaaggaggugcugguccucugggggauccaccaccccagcaccaccgccgaccagcagucccuguaccagaacgccgacacguacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccagaaguccacccagaacgccaucgacaagaucacgaacaaggugaacagcgucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcaccaagaucuaccagauccucgccaucuacuccaccgucgcgagcucccuggugcugguggucagccucggggccaucagcuucuggaugugcuccaacggcagccugcagugccgcaucugcaucuga

SEQ ID NO: 72930 - RNA, 1701 nt, Artificial Sequence; identical to SEQ ID NO: 72928
  derived and/or modified sequence opt1 from hemagglutinin__InfluenzaA__AHV83796

SEQ ID NO: 72931 - RNA, 1701 nt, Artificial Sequence; identical to SEQ ID NO: 71048
  derived and/or modified sequence opt1 from hemagglutinin__InfluenzaA__AHV83798

SEQ ID NO: 72932 - RNA, 1701 nt, Artificial Sequence; identical to SEQ ID NO: 71048
  derived and/or modified sequence opt1 from hemagglutinin__InfluenzaA__AHV83799

SEQ ID NO: 72933 - RNA, 1701 nt, Artificial Sequence
  derived and/or modified sequence opt1 from hemagglutinin__InfluenzaA__AHV83800
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagaagacgcuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgcgagcucccuggugcucguggucagccugggggccaucagcuucuggaugugcuccaacggcagccugcagugccgcaucugcaucuga

SEQ ID NO: 72934 - RNA, 1701 nt, Artificial Sequence
  derived and/or modified sequence opt1 from hemagglutinin__InfluenzaA__AHV83801
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccagaaguccacccagaacgccaucgacaagaucacgaacaaggugaacagcgucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcaccaagaucuaccagauccucgccaucuacuccaccgucgcgagcucccuggugcugguggucagccucggggccaucagcuucuggaugugcuccaacggcagccugcagugccgcaucugcaucuga

SEQ ID NO: 72935 - RNA, 1701 nt, Artificial Sequence
  derived and/or modified sequence opt1 from hemagglutinin__InfluenzaA__AHV83802
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagggccuguaccagaacguggacgccuacguguucgucggcaccucccgguacagcaagaaguucaagcccgagaucgccauccgcccgaaggugcgggaccaggaggggcgcaugaacuacuacuggacccugguggagcccggcgacaagaucaccuucgaggccacggggaaccucgucgugccccgguacgcguucaccauggagcgcaacgccggcuccggcaucaucaucagcgacacccccgugcacgacugcaacaccacgugccagaccccggagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggccaucgcgggcuucaucgagggcggguggaccggcaugguggacgggugguacggcuaccaccaccagaacgagcagggguccggcuacgccgccgaccucaagagcacccagaacgccaucgacaagaucacgaacaaggucaacuccgugaucgagaagaugaacacccaguucaccgccgucggcaaggaguucaaccaccuggagaagcgcaucgagaaccugaacaagaagguggacgacggguuccucgacaucuggaccuacaacgcggagcugcuggugcuccuggagaacgagcggacgcuggacuaccacgacagcaacgucaagaaccucuacgagaaggugcgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggagaagaucgacggggucaagcucgaguccacccgcaucuaccagauccuggccaucuacagcaccguggccuccagccuggugcucgucgugucccugggcgcgaucagcuucuggaugugcagcaacggcucccugcagugccggaucugcaucuga

SEQ ID NO: 72936 - RNA, 1701 nt, Artificial Sequence; identical to SEQ ID NO: 71048
  derived and/or modified sequence opt1 from hemagglutinin__InfluenzaA__AHV83803

SEQ ID NO: 72937 - RNA, 1701 nt, Artificial Sequence; identical to SEQ ID NO: 71048
  derived and/or modified sequence opt1 from hemagglutinin__InfluenzaA__AHV83804

SEQ ID NO: 72938 - RNA, 1701 nt, Artificial Sequence; identical to SEQ ID NO: 71048
  derived and/or modified sequence opt1 from hemagglutinin__InfluenzaA__AHV83805

SEQ ID NO: 72939 - RNA, 1701 nt, Artificial Sequence; identical to SEQ ID NO: 72928
  derived and/or modified sequence opt1 from hemagglutinin__InfluenzaA__AHV83806

SEQ ID NO: 72940 - RNA, 1701 nt, Artificial Sequence
  derived and/or modified sequence opt1 from hemagglutinin__InfluenzaA__AHV83807
augaaggccauccuggugguccuccuguacaccuucgccaccgcgaacgccgacacgcugugcaucggcuaccacgccaacaacagcaccgacaccguggacaccgugcucgagaaggacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 72941 - RNA, 1701 nt, Artificial Sequence
  derived and/or modified sequence opt1 from hemagglutinin__InfluenzaA__AHV83808
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgaggccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacaugugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 72942 - RNA, 1701 nt, Artificial Sequence; identical to SEQ ID NO: 71048
  derived and/or modified sequence opt1 from hemagglutinin__InfluenzaA__AHV83809

SEQ ID NO: 72943 - RNA, 1701 nt, Artificial Sequence; identical to SEQ ID NO: 72029
  derived and/or modified sequence opt1 from hemagglutinin__InfluenzaA__AHV83810

SEQ ID NO: 72944 - RNA, 1701 nt, Artificial Sequence
  derived and/or modified sequence opt1 from hemagglutinin__InfluenzaA__AHV83812
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgaguaccccaaguacuccgaggaggccaagcugaaccgggagaagaucgacggcgugaagcucgagagcaccaagaucuaccagauccuggccaucuacuccaccgucgccagcucccuggugcucguggucagccugggggcgaucagcuucuggaugugcuccaacggcagccugcagugccgcaucugcaucuga

SEQ ID NO: 72945 - RNA, 1701 nt, Artificial Sequence; identical to SEQ ID NO: 71048
  derived and/or modified sequence opt1 from hemagglutinin__InfluenzaA__AHV83813

SEQ ID NO: 72946 - RNA, 1701 nt, Artificial Sequence
  derived and/or modified sequence opt1 from hemagglutinin__InfluenzaA__AHV83814
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggaaccuggacuaccacgacuccaacgugaagaaccucuacgagaagguccgcaaccagcugaagacgaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 72947 - RNA, 1701 nt, Artificial Sequence; identical to SEQ ID NO: 72029
  derived and/or modified sequence opt1 from hemagglutinin__InfluenzaA__AHV83815

SEQ ID NO: 72948 - RNA, 1701 nt, Artificial Sequence; identical to SEQ ID NO: 71048
  derived and/or modified sequence opt1 from hemagglutinin__InfluenzaA__AHV83816

SEQ ID NO: 72949 - RNA, 1701 nt, Artificial Sequence
  derived and/or modified sequence opt1 from hemagglutinin__InfluenzaA__AHV83817
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugguguggcucgugaagaaggggaacagcuaccccaagcugucccagagcuacaucaacgacaagggcaaggagguccuggugcucugggggauccaccaccccagcaccacggccgaccagcagucccuguaccagaacgccgacgccuacguguucgucggcaccagccgguacuccaagaaguucaagcccgagaucgccauccgcccgaaggugcgggaccaggagggccgcaugaacuacuacuggacccugguggagcccggggacaagaucaccuucgaggcgacgggcaaccucgucgugccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgucaaguccacgaagcugcggcucgccaccggccugcgcaacgugccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgucaagcucgagagcacccgcaucuaccagauccuggccaucuacuccaccguggcgagcucccuggugcucgucgugagccugggggccaucagcuucuggaugugcuccaacggcagccugcagugccggaucugcaucuga

SEQ ID NO: 72950 - RNA, 1701 nt, Artificial Sequence; identical to SEQ ID NO: 72928
  derived and/or modified sequence opt1 from hemagglutinin__InfluenzaA__AHV83818

SEQ ID NO: 72951 - RNA, 1701 nt, Artificial Sequence; identical to SEQ ID NO: 72910
  derived and/or modified sequence opt1 from hemagglutinin__InfluenzaA__AHV83819

SEQ ID NO: 72952 - RNA, 1701 nt, Artificial Sequence
  derived and/or modified sequence opt1 from hemagglutinin__InfluenzaA__AHV83821
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucagcccccugcaccucgggaagugcaacaucgccggcuggauccuggggaacccggagugcgagucccugagcaccgccuccagcugguccuacaucguggagaccagcuccagcgacaacggcacgugcuaccccggcgacuucgugaacuacgaggagcuccgggagcagcuguccagcgucuccagcuucgagcgcuucgagaucuuccccaagaccuccagcuggcccaaccacgacuccaacaagggggugaccgcggccugcccgcacgccggcgccaagagcuucuacaagaaccugaucuggcucgugaagaaggggaacuccuaccccaagcugagccagagcuacaucaacgacaagggcaaggagguccuggugcucugggggauccaccaccccuccaccacggcggaccagcagagccuguaccagaacgccgacgccuacguguucgucggcaccucccgguacagcaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucaccauggagcgcaacgccggguccggcaucaucaucagcgacacccccgugcacaacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggucaacuccgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacagcaacgucaagaaccucuacgagaaggugcgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgucaagcucgaguccacccgcaucuaccagauccuggccaucuacagcaccguggccuccagccuggugcucgucgugagccugggggcgaucuccuucuggaugugcagcaacggcucccugcagugccggaucugcaucuga

SEQ ID NO: 72953 - RNA, 1701 nt, Artificial Sequence
  derived and/or modified sequence opt1 from hemagglutinin__InfluenzaA__AHV83822
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucagcccccugcaccucgggaagugcaacaucgccggcuggauccuggggaacccggagugcgagucccugagcaccgccuccagcugguccuacaucguggagaccagcuccagcgacaacggcacgugcuaccccggcgacuucgugaacuacgaggagcuccgggagcagcuguccagcgucuccagcuucgagcgcuucgagaucuuccccaagaccuccagcuggcccaaccacgacuccaacaagggggugaccgcggccugcccgcacgccggcgccaagagcuucuacaagaaccugaucuggcucgugaagaaggggaacuccuaccccaagcugagccagagcuacaucaacgacaagggcaaggagguccuggugcucugggggauccaccaccccuccaccacggcggaccagcagagccuguaccagaacgccgacgccuacguguucgucggcaccucccgguacagcaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucaccauggagcgcaacgccggguccggcaucaucaucagcgacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggucaacuccaucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgccuccagccuggugcucguggucagccugggggcgaucuccuucuggaugugcagcaacggcucccugcagugccggaucugcaucuga

SEQ ID NO: 72954 - RNA, 1701 nt, Artificial Sequence
  derived and/or modified sequence opt1 from hemagglutinin__InfluenzaA__AHV83823
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagaucucccagagcuacaucaacgacaagggcaaggaggugcugguccugugggggauccaccaccccagcaccacggccgaccagcagucccucuaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucaccauggagcgcaacaccgggagcggcaucaucaucuccgacacccccgugcacgacugcaacacgaccugccagaccccggagggcgccaucaacaccagccuccccuuccagaacauccaccccaucacgaucgggaagugccccaaguacgugaaguccaccaagcugcggcuggccaccggccuccgcaacgucccgagcauccagucccgggggcuguucggcgccaucgcgggguucaucgagggcggcuggaccgggaugguggacggcugguacggguaccaccaccagaacgagcagggcagcggguacgccgccgaccugaaguccacgcagaacgccaucgacaagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgcggagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgccaucuacuccaccgucgccagcucccuggugcugguggucagccucggggcgaucagcuucuggaugugcuccaacggcagccugcagugccggaucugcaucuga

SEQ ID NO: 72955 - RNA, 1701 nt, Artificial Sequence
  derived and/or modified sequence opt1 from hemagglutinin__InfluenzaA__AHV83824
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugcggcaguccuacaucaacgacaagggcaaggaggugcugguccucugggggauccaccaccccagcaccacgaccgaccagcagagccuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucacguucgaggccaccggcaaccucguggucccccgcuacgcguucaccauggagcggaacgccggguccggcaucaucaucagcgacacccccgugcacgacugcaacacgaccugccagaccccggagggcgccaucaacaccucccugcccuuccagaacauccaccccaucacgaucgggaagugccccaaguacgucaagagcaccaagcugcgccucgccaccggccugcggaacgugccguccauccagagccgcgggcuguucggcgccaucgcgggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgcggagcugcuggugcuccuggagaacgagcgcaaccuggacuaccacgacagcaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgagaagaucgacggcgugaagcucgaguccacccggaucuaccagauccuggccaucuacagcaccgucgccuccagccuggugcucguggucucccugggggcgaucagcuucuggaugugcagcaacggcucccugcagugccgcaucugcaucuga

SEQ ID NO: 72956 - RNA, 1701 nt, Artificial Sequence; identical to SEQ ID NO: 72928
  derived and/or modified sequence opt1 from hemagglutinin__InfluenzaA__AHV83825

SEQ ID NO: 72957 - RNA, 1701 nt, Artificial Sequence
  derived and/or modified sequence opt1 from hemagglutinin__InfluenzaA__AHV83826
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacuucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgcggccagcucccugguccucguggugagccugggggccaucagcuucuggaugugcuccaacggcagccugcagugccggaucugcaucuga

SEQ ID NO: 72958 - RNA, 1701 nt, Artificial Sequence; identical to SEQ ID NO: 71048
  derived and/or modified sequence opt1 from hemagglutinin__InfluenzaA__AHV83827

SEQ ID NO: 72959 - RNA, 1701 nt, Artificial Sequence; identical to SEQ ID NO: 71048
  derived and/or modified sequence opt1 from hemagglutinin__InfluenzaA__AHV83828

SEQ ID NO: 72960 - RNA, 1701 nt, Artificial Sequence
  derived and/or modified sequence opt1 from hemagglutinin__InfluenzaA__AHV83829
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagaucucccagagcuacaucaacgacaagggcaaggaggugcugguccugugggggauccaccaccccagcaccacggccgaccagcagucccucuaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucaccauggagcgcaacgccgggagcggcaucaucaucuccgacacccccgugcacgacugcaacaccacgugccagaccccggagggcgccaucaacaccagccuccccuuccagaacauccaccccaucaccaucgggaagugccccaaguacgugaaguccacgaagcugcggcuggccaccggccuccgcaacgucccgagcauccagucccgggggcuguucggcgcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacagcgucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgccaucuacuccaccgucgcgagcucccuggugcugguggucagccucggggccaucagcuucuggaugugcuccaacggcagccugcagugccggaucugcaucuga

SEQ ID NO: 72961 - RNA, 1701 nt, Artificial Sequence; identical to SEQ ID NO: 71048
  derived and/or modified sequence opt1 from hemagglutinin__InfluenzaA__AHV83830

SEQ ID NO: 72962 - RNA, 1701 nt, Artificial Sequence
  derived and/or modified sequence opt1 from hemagglutinin__InfluenzaA__AHV83831
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccaucgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccgggagcggcaucaucguguccgacacccccgugcacgacugcaacacgaccugccagaccccggagggcgccaucaacaccagccugcccuuccagaacauccaccccaucaccaucgggaagugccccaaguacgucaaguccaccaagcugcggcucgccacgggccugcgcaacgugccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucaccaacaaggucaacagcgugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgucaagcucgagagcacccgcaucuaccagauccuggccaucuacuccaccguggcgagcucccuggugcucgucgugagccugggggccaucagcuucuggaugugcuccaacggcagccugcagugccggaucugcaucuga

SEQ ID NO: 72963 - RNA, 1701 nt, Artificial Sequence; identical to SEQ ID NO: 72011
  derived and/or modified sequence opt1 from hemagglutinin__InfluenzaA__AHV83832

SEQ ID NO: 72964 - RNA, 1701 nt, Artificial Sequence; identical to SEQ ID NO: 71048
  derived and/or modified sequence opt1 from hemagglutinin__InfluenzaA__AHV83833

SEQ ID NO: 72965 - RNA, 1701 nt, Artificial Sequence; identical to SEQ ID NO: 72029
  derived and/or modified sequence opt1 from hemagglutinin__InfluenzaA__AHV83834

SEQ ID NO: 72966 - RNA, 1701 nt, Artificial Sequence
  derived and/or modified sequence opt1 from hemagglutinin__InfluenzaA__AHV83836
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggagaacagcuaccccaagcugcggcaguccuacaucaacgacaaggggaaggaggugcugguccucuggggcauccaccaccccagcaccacgaccgaccagcagagccuguaccagaacgccgacgccuacguguucguggggaccucccgcuacagcaagaaguucaagcccgagaucgccauccggccgaagguccgcgaccaggagggccggaugaacuacuacuggacccugguggagcccggcgacaagaucacguucgaggccaccgggaaccucguggucccccgcuacgcguucaccauggagcggaacgccggcuccgggaucaucaucagcgacacccccgugcacgacugcaacacgaccugccagaccccggagggcgccaucaacaccucccugcccuuccagaacauccaccccaucacgaucggcaagugccccaaguacgucaagagcaccaagcugcgccucgccaccgggcugcggaacgugccguccauccagagccgcggccuguucggggccaucgcgggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacacccaguucaccgccguggggaaggaguucaaccaccuggagaagcggaucgagaaccugaacaagaaggucgacgacggcuuccucgacaucuggacguacaacgcggagcugcuggugcuccuggagaacgagcgcacccuggacuaccacgacagcaacgugaagaaccucuacgagaagguccggaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgagaagaucgacggggugaagcucgaguccacccggaucuaccagauccuggccaucuacagcaccgucgccuccagccuggugcucguggucucccugggcgcgaucagcuucuggaugugcagcaacgggucccugcagugccgcaucugcaucuga

SEQ ID NO: 72967 - RNA, 1701 nt, Artificial Sequence; identical to SEQ ID NO: 72915
  derived and/or modified sequence opt1 from hemagglutinin__InfluenzaA__AHV83837

SEQ ID NO: 72968 - RNA, 1701 nt, Artificial Sequence; identical to SEQ ID NO: 71048
  derived and/or modified sequence opt1 from hemagglutinin__InfluenzaA__AHV83838

SEQ ID NO: 72969 - RNA, 1701 nt, Artificial Sequence; identical to SEQ ID NO: 72011
  derived and/or modified sequence opt1 from hemagglutinin__InfluenzaA__AHV83839

SEQ ID NO: 72970 - RNA, 1701 nt, Artificial Sequence; identical to SEQ ID NO: 72029
  derived and/or modified sequence opt1 from hemagglutinin__InfluenzaA__AHV83840

SEQ ID NO: 72971 - RNA, 1701 nt, Artificial Sequence
  derived and/or modified sequence opt1 from hemagglutinin__InfluenzaA__AHV83841
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugcggcaguccuacaucaacgacaagggcaaggaggugcugguccucugggggauccaccaccccagcaccacgaccgaccagcagagccuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucacguucgaggccaccggcaaccucguggucccccgcuacgcguucaccauggagcggaacgccggguccggcaucaucaucagcgacacccccgugcacaacugcaacacgaccugccagaccccggagggcgccaucaacaccucccugcccuuccagaacauccaccccaucacgaucgggaagugccccaaguacgucaagagcaccaagcugcgccucgccaccggccugcggaacgugccguccauccagagccgcgggcuguucggcgccaucgcgggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgcggagcugcuggugcuccuggagaacgagcgcacccuggacuaccacgacagcaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgagaagaucgacggcgugaagcucgaguccacccggaucuaccagauccuggccaucuacagcaccgucgccuccagccuggugcucguggucucccugggggcgaucagcuucuggaugugcagcaacggcucccugcagugccgcaucugcaucuga

SEQ ID NO: 72972 - RNA, 1701 nt, Artificial Sequence; identical to SEQ ID NO: 71048
  derived and/or modified sequence opt1 from hemagglutinin__InfluenzaA__AHV83842

SEQ ID NO: 72973 - RNA, 1701 nt, Artificial Sequence; identical to SEQ ID NO: 71048
  derived and/or modified sequence opt1 from hemagglutinin__InfluenzaA__AHV83843

SEQ ID NO: 72974 - RNA, 1701 nt, Artificial Sequence; identical to SEQ ID NO: 71048
  derived and/or modified sequence opt1 from hemagglutinin__InfluenzaA__AHV83844

SEQ ID NO: 72975 - RNA, 1701 nt, Artificial Sequence
  derived and/or modified sequence opt1 from hemagglutinin__InfluenzaA__AHV83845
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccacccgcccaccacggccgaccagcagagccuguaccagaacgccgacgccuacguguucgugggcaccucccgguacagcaagaaguucaagcccgagaucgccauccgccccaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucagcgacaccccggugcacgacugcaacaccacgugccagacccccgagggcgccaucaacaccucccugcccuuccagaacauccaccccaucaccaucgggaagugcccgaaguacgucaagagcacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgcggccuccagccugguccucguggugucccugggggccaucagcuucuggaugugcagcaacggcucccugcagugccggaucugcaucuga

SEQ ID NO: 72976 - RNA, 1701 nt, Artificial Sequence; identical to SEQ ID NO: 71048
  derived and/or modified sequence opt1 from hemagglutinin__InfluenzaA__AHV83846

SEQ ID NO: 72977 - RNA, 1701 nt, Artificial Sequence; identical to SEQ ID NO: 71048
  derived and/or modified sequence opt1 from hemagglutinin__InfluenzaA__AHV83847

SEQ ID NO: 72978 - RNA, 1701 nt, Artificial Sequence; identical to SEQ ID NO: 71048
  derived and/or modified sequence opt1 from hemagglutinin__InfluenzaA__AHV83848

SEQ ID NO: 72979 - RNA, 1701 nt, Artificial Sequence; identical to SEQ ID NO: 72901
  derived and/or modified sequence opt1 from hemagglutinin__InfluenzaA__AHV83849

SEQ ID NO: 72980 - RNA, 1701 nt, Artificial Sequence
  derived and/or modified sequence opt1 from hemagglutinin__InfluenzaA__AHV83850
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaaggccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcaccacggcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 72981 - RNA, 1701 nt, Artificial Sequence; identical to SEQ ID NO: 71048
  derived and/or modified sequence opt1 from hemagglutinin__InfluenzaA__AHV83851

SEQ ID NO: 72982 - RNA, 1701 nt, Artificial Sequence; identical to SEQ ID NO: 71048
  derived and/or modified sequence opt1 from hemagglutinin__InfluenzaA__AHV83852

SEQ ID NO: 72983 - RNA, 1701 nt, Artificial Sequence
  derived and/or modified sequence opt1 from hemagglutinin__InfluenzaA__AHV83853
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacaccuacguguucgugggcaccagccgguacuccaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgcguucgccauggagcgcgacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgccaccgggcugcgcaacgucccgagcauccagucccggggccuguucggggcgaucgccggcuucaucgagggcggguggaccggcaugguggacgggugguacggcuaccaccaccagaacgagcaggggagcggcuacgccgccgaccucaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcacccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgcggccagcucccugguccucguggugagccugggcgccaucuccuucuggaugugcagcaacggcagccugcagugccggaucugcaucuga

SEQ ID NO: 72984 - RNA, 1701 nt, Artificial Sequence; identical to SEQ ID NO: 72910
  derived and/or modified sequence opt1 from hemagglutinin__InfluenzaA__AHV83855

SEQ ID NO: 72985 - RNA, 1701 nt, Artificial Sequence
  derived and/or modified sequence opt1 from hemagglutinin__InfluenzaA__AHV83856
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagaucgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 72986 - RNA, 1701 nt, Artificial Sequence; identical to SEQ ID NO: 72910
  derived and/or modified sequence opt1 from hemagglutinin__InfluenzaA__AHV83857

SEQ ID NO: 72987 - RNA, 1701 nt, Artificial Sequence
  derived and/or modified sequence opt1 from hemagglutinin__InfluenzaA__AHV83858
augaaggccauccuggugguccuccuguacaccuucgccaccgcgaacacggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccagaaguccacgcagaacgccaucgacaagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgcggagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgccaucuacuccaccgucgccagcucccuggugcugguggucagccucggggcgaucagcuucuggaugugcuccaacggcagccugcagugccggaucugcaucuga

SEQ ID NO: 72988 - RNA, 1701 nt, Artificial Sequence; identical to SEQ ID NO: 71048
  derived and/or modified sequence opt1 from hemagglutinin__InfluenzaA__AHV83859

SEQ ID NO: 72989 - RNA, 1701 nt, Artificial Sequence
  derived and/or modified sequence opt1 from hemagglutinin__InfluenzaA__AHV83861
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 72990 - RNA, 1701 nt, Artificial Sequence; identical to SEQ ID NO: 72989
  derived and/or modified sequence opt1 from hemagglutinin__InfluenzaA__AHV83862

SEQ ID NO: 72991 - RNA, 1701 nt, Artificial Sequence; identical to SEQ ID NO: 71048
  derived and/or modified sequence opt1 from hemagglutinin__InfluenzaA__AHV83863

SEQ ID NO: 72992 - RNA, 1701 nt, Artificial Sequence; identical to SEQ ID NO: 71048
  derived and/or modified sequence opt1 from hemagglutinin__InfluenzaA__AHV83864

SEQ ID NO: 72993 - RNA, 1701 nt, Artificial Sequence
  derived and/or modified sequence opt1 from hemagglutinin__InfluenzaA__AHV83866
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccauccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacgacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 72994 - RNA, 1701 nt, Artificial Sequence
  derived and/or modified sequence opt1 from hemagglutinin__InfluenzaA__AHV83867
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacgacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 72995 - RNA, 1701 nt, Artificial Sequence; identical to SEQ ID NO: 71048
  derived and/or modified sequence opt1 from hemagglutinin__InfluenzaA__AHV83868

SEQ ID NO: 72996 - RNA, 1701 nt, Artificial Sequence
  derived and/or modified sequence opt1 from hemagglutinin__InfluenzaA__AHV83869
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccaacagcuggcccaaccacgacuccaacaagggggucaccgccgccugcccgcacgccggcgccaagagcuucuacaagaaccugaucuggcucgugaagaaggggaacuccuaccccaagcugagccaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucagcgacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 72997 - RNA, 1701 nt, Artificial Sequence; identical to SEQ ID NO: 71048
  derived and/or modified sequence opt1 from hemagglutinin__InfluenzaA__AHV83870

SEQ ID NO: 72998 - RNA, 1701 nt, Artificial Sequence; identical to SEQ ID NO: 71048
  derived and/or modified sequence opt1 from hemagglutinin__InfluenzaA__AHV83871

SEQ ID NO: 72999 - RNA, 1701 nt, Artificial Sequence; identical to SEQ ID NO: 71048
  derived and/or modified sequence opt1 from hemagglutinin__InfluenzaA__AHV83872

SEQ ID NO: 73000 - RNA, 1701 nt, Artificial Sequence
  derived and/or modified sequence opt1 from hemagglutinin__InfluenzaA__AHV83873
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgguggcggaccagcagucccuguaccagaacgccgacgccuacguguucgucggcaccagccgguacuccaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgucaaguccacgaagcugcggcucgccaccggccugcgcaacgugccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgucaagcucgagagcacccgcaucuaccagauccuggccaucuacuccaccguggccagcucccuggugcucgucgugagccugggggcgaucagcuucuggaugugcuccaacggcagccugcagugccggaucugcaucuga

SEQ ID NO: 73001 - RNA, 1701 nt, Artificial Sequence; identical to SEQ ID NO: 71048
  derived and/or modified sequence opt1 from hemagglutinin__InfluenzaA__AHV83874

SEQ ID NO: 73002 - RNA, 1701 nt, Artificial Sequence; identical to SEQ ID NO: 71048
  derived and/or modified sequence opt1 from hemagglutinin__InfluenzaA__AHV83875

SEQ ID NO: 73003 - RNA, 1701 nt, Artificial Sequence; identical to SEQ ID NO: 71048
  derived and/or modified sequence opt1 from hemagglutinin__InfluenzaA__AHV83876

SEQ ID NO: 73004 - RNA, 1701 nt, Artificial Sequence
  derived and/or modified sequence opt1 from hemagglutinin__InfluenzaA__AHV83877
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucaagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73005 - RNA, 1701 nt, Artificial Sequence; identical to SEQ ID NO: 72915
  derived and/or modified sequence opt1 from hemagglutinin__InfluenzaA__AHV83878

SEQ ID NO: 73006 - RNA, 1701 nt, Artificial Sequence; identical to SEQ ID NO: 72915
  derived and/or modified sequence opt1 from hemagglutinin__InfluenzaA__AHV83879

SEQ ID NO: 73007 - RNA, 1701 nt, Artificial Sequence
  derived and/or modified sequence opt1 from hemagglutinin__InfluenzaA__AHV83881
augaaggccacccuggugguccuccuguacaccuucgccacggcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcacgaccgccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73008 - RNA, 1701 nt, Artificial Sequence; identical to SEQ ID NO: 72029
  derived and/or modified sequence opt1 from hemagglutinin__InfluenzaA__AHV83882

SEQ ID NO: 73009 - RNA, 1701 nt, Artificial Sequence; identical to SEQ ID NO: 72011
  derived and/or modified sequence opt1 from hemagglutinin__InfluenzaA__AHV83883

SEQ ID NO: 73010 - RNA, 1701 nt, Artificial Sequence; identical to SEQ ID NO: 71048
  derived and/or modified sequence opt1 from hemagglutinin__InfluenzaA__AHV83884

SEQ ID NO: 73011 - RNA, 1701 nt, Artificial Sequence
  derived and/or modified sequence opt1 from hemagglutinin__InfluenzaA__AHV83885
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccguguacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73012 - RNA, 1701 nt, Artificial Sequence; identical to SEQ ID NO: 72928
  derived and/or modified sequence opt1 from hemagglutinin__InfluenzaA__AHV83887

SEQ ID NO: 73013 - RNA, 1701 nt, Artificial Sequence; identical to SEQ ID NO: 71048
  derived and/or modified sequence opt1 from hemagglutinin__InfluenzaA__AHV83888

SEQ ID NO: 73014 - RNA, 1701 nt, Artificial Sequence
  derived and/or modified sequence opt1 from hemagglutinin__InfluenzaA__AHV83889
augaaggccauccuggugguccuccugcacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucaacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcugucccagagcuacaucaacgacaagggcaaggaggugcucguccugugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccucguggagcccggggacaagaucaccuucgaggcgacgggcaaccugguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcuccggcuggccaccggccugcgcaacgucccgagcauccagucccggggccucuucggggcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacagcgucaucgagaagaugaacacccaguucaccgcggugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagagcacccgcaucuaccagauccuggccaucuacuccaccgucgcgagcucccucgugcugguggucagccugggggccaucagcuucuggaugugcuccaacggcagccuccagugccggaucugcaucuga

SEQ ID NO: 73015 - RNA, 1701 nt, Artificial Sequence; identical to SEQ ID NO: 71048
  derived and/or modified sequence opt1 from hemagglutinin__InfluenzaA__AHV83890

SEQ ID NO: 73016 - RNA, 1701 nt, Artificial Sequence; identical to SEQ ID NO: 71048
  derived and/or modified sequence opt1 from hemagglutinin__InfluenzaA__AHV83891

SEQ ID NO: 73017 - RNA, 1701 nt, Artificial Sequence; identical to SEQ ID NO: 71048
  derived and/or modified sequence opt1 from hemagglutinin__InfluenzaA__AHV83893

SEQ ID NO: 73018 - RNA, 1701 nt, Artificial Sequence; identical to SEQ ID NO: 71048
  derived and/or modified sequence opt1 from hemagglutinin__InfluenzaA__AHV83894

SEQ ID NO: 73019 - RNA, 1701 nt, Artificial Sequence
  derived and/or modified sequence opt1 from hemagglutinin__InfluenzaA__AHV83895
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggagaccaagcugaaccgggagaagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 73020 - RNA, 1701 nt, Artificial Sequence; identical to SEQ ID NO: 71048
  derived and/or modified sequence opt1 from hemagglutinin__InfluenzaA__AHV83896

SEQ ID NO: 73021 - RNA, 1701 nt, Artificial Sequence; identical to SEQ ID NO: 71048
  derived and/or modified sequence opt1 from hemagglutinin__InfluenzaA__AHV83897

SEQ ID NO: 73022 - RNA, 1701 nt, Artificial Sequence
  derived and/or modified sequence opt1 from hemagglutinin__InfluenzaA__AHV83898
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgucaccggccugcgcaacgugccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgucaagcucgagagcacccgcaucuaccagauccuggccaucuacuccaccguggccagcucccuggugcucgucgugagccugggggcgaucagcuucuggaugugcuccaacggcagccugcagugccggaucugcaucuga

SEQ ID NO: 73023 - RNA, 1701 nt, Artificial Sequence; identical to SEQ ID NO: 71048
  derived and/or modified sequence opt1 from hemagglutinin__InfluenzaA__AHV83899

SEQ ID NO: 73024 - RNA, 1701 nt, Artificial Sequence; identical to SEQ ID NO: 71048
  derived and/or modified sequence opt1 from hemagglutinin__InfluenzaA__AHV83900

SEQ ID NO: 73025 - RNA, 1701 nt, Artificial Sequence; identical to SEQ ID NO: 71048
  derived and/or modified sequence opt1 from hemagglutinin__InfluenzaA__AHV83901

SEQ ID NO: 73026 - RNA, 1701 nt, Artificial Sequence; identical to SEQ ID NO: 71048
  derived and/or modified sequence opt1 from hemagglutinin__InfluenzaA__AHV83902

SEQ ID NO: 73027 - RNA, 1701 nt, Artificial Sequence; identical to SEQ ID NO: 71048
  derived and/or modified sequence opt1 from hemagglutinin__InfluenzaA__AHV83903

SEQ ID NO: 73028 - RNA, 1701 nt, Artificial Sequence; identical to SEQ ID NO: 71048
  derived and/or modified sequence opt1 from hemagglutinin__InfluenzaA__AHV83904

SEQ ID NO: 73029 - RNA, 1701 nt, Artificial Sequence
  derived and/or modified sequence opt1 from hemagglutinin__InfluenzaA__AHV83905
augaaggccauccuggugguccuccuguacacccugaccacggccaacgcggacacccucugcaucggcuaccacgccaacaacagcaccgacaccguggacacggugcuggagaagaacgucaccgugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagacguccagcuccgacaacgggaccugcuaccccggcgacuucaucaacuacgaggagcugcgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccucaucuggcuggugaagaaggggaacagcuaccccaagcugucccagagcuacaucaacgacaagggcaaggaggugcucguccugugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccucguggagcccggggacaagaucacguucgaggccaccggcaaccugguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcuccggcuggccaccggccugcgcaacgucccgagcauccagucccggggccucuucggcgccaucgcgggguucaucgagggcggcuggaccgggaugguggacggcugguacggguaccaccaccagaacgagcagggcagcggguacgccgccgaccugaaguccacgcagaacgccaucgacaagaucaccaacaaggugaacagcgucaucgagaagaugaacacccaguucaccgccgugggcaaggaguucaaccaccuggagaagcgcaucgagaaccucaacaagaaggucgacgacggcuuccuggacaucuggacguacaacgcggagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagagcacccgcaucuaccagauccuggccaucuacuccaccgucgccagcucccucgugcugguggucagccugggggcgaucagcuucuggaugugcuccaacggcagccuccagugccggaucugcaucuga

SEQ ID NO: 73030 - RNA, 1701 nt, Artificial Sequence; identical to SEQ ID NO: 71048
  derived and/or modified sequence opt1 from hemagglutinin__InfluenzaA__AHV83906

SEQ ID NO: 73031 - RNA, 1701 nt, Artificial Sequence; identical to SEQ ID NO: 71048
  derived and/or modified sequence opt1 from hemagglutinin__InfluenzaA__AHV83907

SEQ ID NO: 73032 - RNA, 1701 nt, Artificial Sequence
  derived and/or modified sequence opt1 from hemagglutinin__InfluenzaA__AHV83908
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagccccugagcaccgcguccagcugguccuacaucguggagaccagcuccagcgacaacggcacgugcuaccccggcgacuucaucaacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagccaguccuacaucaacgacaagggcaagaaggugcugguccucugggggauccaccaccccagcaccacggccgaccagcagagccuguaccagaacgccgacgccuacguguucgugggcaccucccgguacagcaagaaguucaagccggagaucgccauccgccccaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucagcgacaccccggugcacgacugcaacaccacgugccagacccccgagggcgccaucaacaccucccugcccuuccagaacauccaccccaucaccaucgggaagugcccgaaguacgucaagagcacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 73033 - RNA, 1701 nt, Artificial Sequence
  derived and/or modified sequence opt1 from hemagglutinin__InfluenzaA__AHV83911
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagccccugagcaccgcguccagcugguccuacaucguggagaccagcuccagcgacaacggcacgugcuaccccggcgacuucaucaacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagccaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagccggagaucgccauccgccccaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucagcgacaccccggugcacgacugcaacaccacgugccagacccccgagggcgccaucaacaccucccugcccuuccagaacauccaccccaucaccaucgggaagugcccgaaguacgucaagagcacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 73034 - RNA, 1701 nt, Artificial Sequence; identical to SEQ ID NO: 71048
  derived and/or modified sequence opt1 from hemagglutinin__InfluenzaA__AHV83912

SEQ ID NO: 73035 - RNA, 1701 nt, Artificial Sequence; identical to SEQ ID NO: 71048
  derived and/or modified sequence opt1 from hemagglutinin__InfluenzaA__AHV83913

SEQ ID NO: 73036 - RNA, 1701 nt, Artificial Sequence; identical to SEQ ID NO: 71048
  derived and/or modified sequence opt1 from hemagglutinin__InfluenzaA__AHV83915

SEQ ID NO: 73037 - RNA, 1701 nt, Artificial Sequence; identical to SEQ ID NO: 71048
  derived and/or modified sequence opt1 from hemagglutinin__InfluenzaA__AHV83916

SEQ ID NO: 73038 - RNA, 1701 nt, Artificial Sequence; identical to SEQ ID NO: 73033
  derived and/or modified sequence opt1 from hemagglutinin__InfluenzaA__AHV83917

SEQ ID NO: 73039 - RNA, 1701 nt, Artificial Sequence; identical to SEQ ID NO: 72011
  derived and/or modified sequence opt1 from hemagglutinin__InfluenzaA__AHV83919

SEQ ID NO: 73040 - RNA, 1701 nt, Artificial Sequence; identical to SEQ ID NO: 72928
  derived and/or modified sequence opt1 from hemagglutinin__InfluenzaA__AHV83920

SEQ ID NO: 73041 - RNA, 1701 nt, Artificial Sequence; identical to SEQ ID NO: 72029
  derived and/or modified sequence opt1 from hemagglutinin__InfluenzaA__AHV83921

SEQ ID NO: 73042 - RNA, 1701 nt, Artificial Sequence
  derived and/or modified sequence opt1 from hemagglutinin__InfluenzaA__AHV83922
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucucccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 73043 - RNA, 1701 nt, Artificial Sequence; identical to SEQ ID NO: 72944
  derived and/or modified sequence opt1 from hemagglutinin__InfluenzaA__AHV83923

SEQ ID NO: 73044 - RNA, 1701 nt, Artificial Sequence; identical to SEQ ID NO: 72928
  derived and/or modified sequence opt1 from hemagglutinin__InfluenzaA__AHV83924

SEQ ID NO: 73045 - RNA, 1701 nt, Artificial Sequence; identical to SEQ ID NO: 72944
  derived and/or modified sequence opt1 from hemagglutinin__InfluenzaA__AHV83925

SEQ ID NO: 73046 - RNA, 1701 nt, Artificial Sequence; identical to SEQ ID NO: 72928
  derived and/or modified sequence opt1 from hemagglutinin__InfluenzaA__AHV83926

SEQ ID NO: 73047 - RNA, 1701 nt, Artificial Sequence; identical to SEQ ID NO: 73033
  derived and/or modified sequence opt1 from hemagglutinin__InfluenzaA__AHV83927

SEQ ID NO: 73048 - RNA, 1701 nt, Artificial Sequence
  derived and/or modified sequence opt1 from hemagglutinin__InfluenzaA__AHV83928
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccagaaguccacgcagaacgccaucgacaagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgcggagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgccaucuacuccaccgucgccagcucccuggugcugguggucagccucggggcgaucagcuucuggaugugcuccaacggcagccugcagugccggaucugcaucuga

SEQ ID NO: 73049 - RNA, 1701 nt, Artificial Sequence; identical to SEQ ID NO: 72928
  derived and/or modified sequence opt1 from hemagglutinin__InfluenzaA__AHV83929

SEQ ID NO: 73050 - RNA, 1701 nt, Artificial Sequence
  derived and/or modified sequence opt1 from hemagglutinin__InfluenzaA__AHV83930
augaaggccauccuggugauccuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcugucccagagcuacaucaacgacaagggcaaggaggugcuggugcucugggggauccaccaccccagcaccacggccgaccagcagucccuguaccagaacgccgacgccuacgucuucgugggcaccagccgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 73051 - RNA, 1701 nt, Artificial Sequence; identical to SEQ ID NO: 72928
  derived and/or modified sequence opt1 from hemagglutinin__InfluenzaA__AHV83931

SEQ ID NO: 73052 - RNA, 1701 nt, Artificial Sequence; identical to SEQ ID NO: 71048
  derived and/or modified sequence opt1 from hemagglutinin__InfluenzaA__AHV83932

SEQ ID NO: 73053 - RNA, 1701 nt, Artificial Sequence
  derived and/or modified sequence opt1 from hemagglutinin__InfluenzaA__AHV83933
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgcggccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccagaaguccacgcagaacgccaucgacaagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgcggagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgcccuguacuccaccgucgccagcucccuggugcucguggucagccugggggcgaucagcuucuggaugugcuccaacggcagccugcagugccggaucugcaucuga

SEQ ID NO: 73054 - RNA, 1701 nt, Artificial Sequence; identical to SEQ ID NO: 72011
  derived and/or modified sequence opt1 from hemagglutinin__InfluenzaA__AHV83934

SEQ ID NO: 73055 - RNA, 1701 nt, Artificial Sequence; identical to SEQ ID NO: 71048
  derived and/or modified sequence opt1 from hemagglutinin__InfluenzaA__AHV83935

SEQ ID NO: 73056 - RNA, 1701 nt, Artificial Sequence; identical to SEQ ID NO: 71048
  derived and/or modified sequence opt1 from hemagglutinin__InfluenzaA__AHV83937

SEQ ID NO: 73057 - RNA, 1701 nt, Artificial Sequence
  derived and/or modified sequence opt1 from hemagglutinin__InfluenzaA__AHV83938
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagaucucccagagcuacaucaacgacaagggcaaggaggugcugguccugugggggauccaccaccccagcaccacggccgaccagcagucccucuaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucaccauggagcgcaacgccgggagcggcaucaucaucuccgacacccccgugcacgacugcaacaccacgugccagaccccggagggcgccaucaacaccagccuccccuuccagaacauccaccccaucaccaucgggaagugccccaaguacgugaaguccacgaagcugcggcuggccaccggccuccgcaacgucccgagcauccagucccgggggcuguucggcgcgaucgccggguucaucgagggcggcuggaccgggaugguggacggcugguacggguaccaccaccagaacgagcagggcagcggguacgccgccgaccagaaguccacccagaacgccaucgacaagaucacgaacaaggugaacagcgucaucgagaagaugaacacccaguucaccgcggugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagagcacccgcaucuaccagauccuggccaucuacuccaccgucgcgagcucccucgugcugguggucagccugggggccaucagcuucuggaugugcuccaacggcagccuccagugccggaucugcaucuga

SEQ ID NO: 73058 - RNA, 1701 nt, Artificial Sequence; identical to SEQ ID NO: 73057
  derived and/or modified sequence opt1 from hemagglutinin__InfluenzaA__AHV83939

SEQ ID NO: 73059 - RNA, 1701 nt, Artificial Sequence
  derived and/or modified sequence opt1 from hemagglutinin__InfluenzaA__AHV83940
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccagaaguccacccagaacgccaucgacaagaucacgaacaaggugaacagcgucaucgagaagaugaacacccaguucaccgcggugggcaaggaguucaaccaccucgagaagcgcaucgagaaccugaacaagaaggucgacgacggcuucauggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgaccgcgugaagcuggagagcacccggaucuaccagauccuggccaucuacuccaccgucgcgagcucccucgugcugguggucagccugggcgccaucagcuucuggaugugcuccaacgggagccuccagugccgcaucugcaucuga

SEQ ID NO: 73060 - RNA, 1701 nt, Artificial Sequence; identical to SEQ ID NO: 71048
  derived and/or modified sequence opt1 from hemagglutinin__InfluenzaA__AHV83941

SEQ ID NO: 73061 - RNA, 1701 nt, Artificial Sequence
  derived and/or modified sequence opt1 from hemagglutinin__InfluenzaA__AHV83943
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacaugugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73062 - RNA, 1701 nt, Artificial Sequence
  derived and/or modified sequence opt1 from hemagglutinin__InfluenzaA__AHV83944
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacgagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73063 - RNA, 1701 nt, Artificial Sequence
  derived and/or modified sequence opt1 from hemagglutinin__InfluenzaA__AHV83945
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacgaccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 73064 - RNA, 1701 nt, Artificial Sequence
  derived and/or modified sequence opt1 from hemagglutinin__InfluenzaA__AHV83947
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccgugaagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgucaaguccacgaagcugcggcucgccaccggccugcgcaacgugccgagcauccagucccgggggcuguucggcgcgaucgccggguucaucgagggcggcuggaccgggaugguggacggcugguacggguaccaccaccagaacgagcagggcagcggguacgccgccgaccagaaguccacccagaacgccaucgacaagaucacgaacaaggucaacagcgugaucgagaagaugaacacccaguucaccgcggucggcaaggaguucaaccaccucgagaagcgcaucgagaaccugaacaagaagguggacgacggcuuccuggacaucuggaccuacaacgccgagcuccuggugcugcucgagaacgagcggacgcuggacuaccacgacuccaacgucaagaaccuguacgagaaggugcgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgucaagcuggagagcacccgcaucuaccagauccucgccaucuacuccaccguggcgagcucccuggugcuggucgugagccucggggccaucagcuucuggaugugcuccaacggcagccugcagugccggaucugcaucuga

SEQ ID NO: 73065 - RNA, 1701 nt, Artificial Sequence; identical to SEQ ID NO: 71048
  derived and/or modified sequence opt1 from hemagglutinin__InfluenzaA__AHV83948

SEQ ID NO: 73066 - RNA, 1701 nt, Artificial Sequence; identical to SEQ ID NO: 71048
  derived and/or modified sequence opt1 from hemagglutinin__InfluenzaA__AHV83949

SEQ ID NO: 73067 - RNA, 1701 nt, Artificial Sequence; identical to SEQ ID NO: 71048
  derived and/or modified sequence opt1 from hemagglutinin__InfluenzaA__AHV83950

SEQ ID NO: 73068 - RNA, 1701 nt, Artificial Sequence
  derived and/or modified sequence opt1 from hemagglutinin__InfluenzaA__AHV83953
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggaccucggcaacgggugcuucaagaucuaccacaagugcgacaacgccugcaucggcuccauccgcaacgggacguacgaccacgacguguaccgggacgaggcccugaacaaccgcuuccagaucaagggcguggagcucaagagcggcuacaaggacuggauccuguggaucuccuucgccaucagcugcuuccugcugugcgucgcccuccugggguucaucaugugggcgugccagaagggcaacauccggugcaacaucugcaucuga

SEQ ID NO: 73069 - RNA, 1701 nt, Artificial Sequence; identical to SEQ ID NO: 72900
  derived and/or modified sequence opt1 from hemagglutinin__InfluenzaA__AHV83954

SEQ ID NO: 73070 - RNA, 1701 nt, Artificial Sequence
  derived and/or modified sequence opt1 from hemagglutinin__InfluenzaA__AHV83956
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgagaacuucaacugggccggggugacgcagaacggcaccuccagcgccugcauccggggguccaacagcuccuucuucagccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccggaucaccguguccaccaagcgcagccagcaggccgugaucccgaacaucggcagccggccccgcauccggaacauccccucccgcaucagcaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcucgccacggggaugcgcaacguccaggagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggcgugccagaagggcaacauccggugcaacaucugcaucuga

SEQ ID NO: 73071 - RNA, 1701 nt, Artificial Sequence
  derived and/or modified sequence opt1 from hemagglutinin__InfluenzaA__AHZ13523
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgugaacuccuucuucagccggcugaacuggcucuacaaguccgagagcaaguaccccguccugaacgugaccaugcccaacaacggcaaguucgacaagcuguacaucuggggcgugcaccaccccuccacggacaaggagcagaccaaccucuacguccgcgccagcgggcgggugaccgugagcaccaagcgcucccagcagacggucaucccgaacaucggcagccggcccugggugcgcgggcuguccagccggaucuccaucuacuggaccaucgugaagcccggcgacauccugcucaucaacagcaccggcaaccugaucgcgccccgcggguacuucaagauccggaccggcaaguccagcaucaugcgcuccgacgccccgaucgggacgugcagcuacgagugcaucacccccaacggcuccauccccaacgacaagcccuuccagaacgucaacaagaucaccuacggggccugcccgcgguacgugaagcagaacacccugaagcucgccacgggcaugcgcaacgugcccgagaagcagacccggggcaucuucggggccaucgcgggcuucaucgagaacgggugggagggcauggucgacgggugguacggcuuccgccaccagaacagcgagggcaccgggcaggccgccgaccugaaguccacccaggccgccaucgaccagaucaacggcaagcugaaccggcucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggaagcagcugcgcgagaacgccgaggacaugggcaacgggugcuucaagaucuaccacaagugcgacaacgccugcaucggcuccauccgcaacggcaccuacaaccacgacguguaccgggacgaggcccucaacaaccgcuuccagaucaagggggucgagcugaaguccggcuacaaggacuggauccuguggaucuccuucgcgaucagcugcuuccuccugugcguggugcugcucggguucaucaugugggccugccagaagggcaacauccggugcaacaucugcaucuga

SEQ ID NO: 73072 - RNA, 1698 nt, Artificial Sequence; identical to SEQ ID NO: 64624
  derived and/or modified sequence opt1 from hemagglutinin__InfluenzaA__AHZ13582

SEQ ID NO: 73073 - RNA, 1701 nt, Artificial Sequence
  derived and/or modified sequence opt1 from hemagglutinin__InfluenzaA__AHZ35584
augaagaccaucaucgcccugagcuacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagagcuccagcaccggggagaucugcaacagcccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgagccugcggucccugguggccagcuccggcacgcucgaguucaacaacgagagcuucaacuggaccggcgucacccagaacgggaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccagcggccggaucaccgucuccacgaagcgcagccagcaggccgugaucccgaacaucgggagccggccccgcgugcggaacauccccucccgcgucagcaucuacuggaccaucgugaagcccggcgacauccugcugaucaacuccaccggcaaccucaucgccccgcggggguacuucaagauccgcagcggcaaguccagcaucaugcgguccgacgcccccaucgggaagugcaacagcgcgugcaucacccccaacggcuccauccccaacgacaagccguuccagaacgugaaccgcaucacguacggcgccugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacagcgagggccgggggcaggcggccgaccucaaguccacgcaggccgccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagagcggguacaaggacuggauccuguggaucuccuucgccaucagcugcuuccugcucugcguggcgcugcugggcuucaucaugugggccugccagaagggcaacauccggugcaacaucugcaucuga

SEQ ID NO: 73074 - RNA, 1701 nt, Artificial Sequence
  derived and/or modified sequence opt1 from hemagglutinin__InfluenzaA__AHZ35608
augaagaccaucaucgcccugagcuacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagagcuccagcaccggggagaucugcaacagcccccaccagauccuggacggcgagaacugcacccucaucgacgcccugcugggggacccccagugcgacgacuuccagaacaaggagugggaccucuucgucgagcgcuccaaggcccacuccaacugcuaccccuacgacgugccggacuacgcgagccugcggucccugguggccagcuccggcacgcucgaguucaacaacgagagcuucaacuggaccggcgucacccagaacgggaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccagcggccggaucaccgucuccacgaagcgcagccagcaggccgugaucccgaacaucgggagccggccccgcgugcggaacauccccucccgcgucagcaucuacuggaccaucgugaagcccggcgacauccugcugaucaacuccaccggcaaccucaucgccccgcggggguacuucaagauccgcagcggcaaguccagcaucaugcgguccgacgcccccaucgggaagugcaacagcgcgugcaucacccccaacggcuccauccccaacgacaagccguuccagaacgugaaccgcaucacguacgggaccugcccccgguacgucaagcagaacacccugaagcuggccaccggcaugcgcaacgugcccgagaagcagacgcggggcaucuucggggccaucgccggcuucaucgagaacgggugggagggcaugguggacggcugguacggguuccgccaccagaacagcgagggccgggggcaggccgcggaccucaaguccacccaggccgccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagagcggguacaaggacuggauccuguggaucuccuucgccaucagcugcuuccugcucugcguggcccugcugggcuucaucaugugggcgugccagaagggcaacauccggugcaacaucugcaucuga

SEQ ID NO: 73075 - RNA, 1701 nt, Artificial Sequence; identical to SEQ ID NO: 73073
  derived and/or modified sequence opt1 from hemagglutinin__InfluenzaA__AHZ35620

SEQ ID NO: 73076 - RNA, 1701 nt, Artificial Sequence; identical to SEQ ID NO: 73073
  derived and/or modified sequence opt1 from hemagglutinin__InfluenzaA__AHZ35632

SEQ ID NO: 73077 - RNA, 1701 nt, Artificial Sequence; identical to SEQ ID NO: 73073
  derived and/or modified sequence opt1 from hemagglutinin__InfluenzaA__AHZ35644

SEQ ID NO: 73078 - RNA, 1701 nt, Artificial Sequence; identical to SEQ ID NO: 73073
  derived and/or modified sequence opt1 from hemagglutinin__InfluenzaA__AHZ35656

SEQ ID NO: 73079 - RNA, 1701 nt, Artificial Sequence; identical to SEQ ID NO: 73073
  derived and/or modified sequence opt1 from hemagglutinin__InfluenzaA__AHZ35668

SEQ ID NO: 73080 - RNA, 1701 nt, Artificial Sequence; identical to SEQ ID NO: 73074
  derived and/or modified sequence opt1 from hemagglutinin__InfluenzaA__AHZ35680

SEQ ID NO: 73081 - RNA, 1701 nt, Artificial Sequence; identical to SEQ ID NO: 73073
  derived and/or modified sequence opt1 from hemagglutinin__InfluenzaA__AHZ35692

SEQ ID NO: 73082 - RNA, 1701 nt, Artificial Sequence; identical to SEQ ID NO: 73073
  derived and/or modified sequence opt1 from hemagglutinin__InfluenzaA__AHZ35716

SEQ ID NO: 73083 - RNA, 1701 nt, Artificial Sequence; identical to SEQ ID NO: 73074
  derived and/or modified sequence opt1 from hemagglutinin__InfluenzaA__AHZ35728

SEQ ID NO: 73084 - RNA, 1701 nt, Artificial Sequence; identical to SEQ ID NO: 73073
  derived and/or modified sequence opt1 from hemagglutinin__InfluenzaA__AHZ35740

SEQ ID NO: 73085 - RNA, 1701 nt, Artificial Sequence; identical to SEQ ID NO: 73073
  derived and/or modified sequence opt1 from hemagglutinin__InfluenzaA__AHZ35752

SEQ ID NO: 73086 - RNA, 1701 nt, Artificial Sequence; identical to SEQ ID NO: 73073
  derived and/or modified sequence opt1 from hemagglutinin__InfluenzaA__AHZ35764

SEQ ID NO: 73087 - RNA, 1701 nt, Artificial Sequence; identical to SEQ ID NO: 73073
  derived and/or modified sequence opt1 from hemagglutinin__InfluenzaA__AHZ35776

SEQ ID NO: 73088 - RNA, 1701 nt, Artificial Sequence
  derived and/or modified sequence opt1 from hemagglutinin__InfluenzaA__AHZ35823
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagauguuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 73089 - RNA, 1701 nt, Artificial Sequence; identical to SEQ ID NO: 73088
  derived and/or modified sequence opt1 from hemagglutinin__InfluenzaA__AHZ35834

SEQ ID NO: 73090 - RNA, 1701 nt, Artificial Sequence; identical to SEQ ID NO: 73088
  derived and/or modified sequence opt1 from hemagglutinin__InfluenzaA__AHZ35845

SEQ ID NO: 73091 - RNA, 1701 nt, Artificial Sequence; identical to SEQ ID NO: 73088
  derived and/or modified sequence opt1 from hemagglutinin__InfluenzaA__AHZ35856

SEQ ID NO: 73092 - RNA, 1701 nt, Artificial Sequence
  derived and/or modified sequence opt1 from hemagglutinin__InfluenzaA__AHZ35867
augaagaccaacaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcaacagcccccaccagauccucgacggcgagaacugcacccugaucgacgcccugcucggggacccccagugcgacggcuuccagaacaagaagugggaccuguucguggagcgcuccaaggcccacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcgcccaucggcaagugcaacagcgccugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacagcgaggggcggggccaggccgccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgcggagcuccuggucgugcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcgcugcucggcuucaucaugugggccugccagaaggggaacauccggugcaacaucugcaucuga

SEQ ID NO: 73093 - RNA, 1701 nt, Artificial Sequence
  derived and/or modified sequence opt1 from hemagglutinin__InfluenzaA__AHZ35879
augaagaccaacaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcaacagcccccaccagauccucgacggcgagaacugcacccugaucgacgcccugcucggggacccccagugcgacggcuuccagaacaagaagugggaccuguucguggagcgcuccaaggcccacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcgcccaucggcaagugcaacagcgccugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacagcgaggggcggggccaggccgccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgcggagcuccuggucgcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcucaagagcggcuacaaggacuggauccuguggaucuccuucgcgaucagcugcuuccugcugugcgucgcccugcucggcuucaucaugugggccugccagaaggggaacauccggugcaacaucugcaucuga

SEQ ID NO: 73094 - RNA, 1701 nt, Artificial Sequence; identical to SEQ ID NO: 73088
  derived and/or modified sequence opt1 from hemagglutinin__InfluenzaA__AHZ35891

SEQ ID NO: 73095 - RNA, 1701 nt, Artificial Sequence; identical to SEQ ID NO: 73088
  derived and/or modified sequence opt1 from hemagglutinin__InfluenzaA__AHZ35902

SEQ ID NO: 73096 - RNA, 1710 nt, Artificial Sequence
  derived and/or modified sequence opt1 from hemagglutinin__InfluenzaA__AHZ35913
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagauguuccccaagacgagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugaccucccugcccuuccagaacauccaccccaucaccaucgggaagugccccaaguacgucaagagcaccaagcuccggcuggcgacgggccugcgcaacgugccguccauccagagccggggccucuucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccuggacaucuggaccuacaacgccgagcugcucgugcugcuggagaacgagcggacccucgacuaccacgacagcaacgugaagaaccuguacgagcgcguccggaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgcgaggagaucgacggcgugaagcuggaguccacccggaucuaccagauccuggcgaucuacagcaccgucgccuccagccucgugcugguggucagccugggggccaucuccuucuggaugugcagcaacggcucccuccagugccgcaucugcaucuga

SEQ ID NO: 73097 - RNA, 1701 nt, Artificial Sequence
  derived and/or modified sequence opt1 from hemagglutinin__InfluenzaA__AHZ35924
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccacgcagagccgcgggcuguucggcgccaucgccggguucaucgagggcggcuggaccgggaugguggacggcugguacggguaccaccaccagaacgcccagggcuccggguacgccgcggaccucaagagcacccagaacgccaucgacaagaucaccaacaaggugaacuccgucaucgagaagaugaacacgcaguucaccgccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggcgaagcucaaccgcgaggagaucgacggcgugaagcuggagagcacccggaucuaccagauccuggccaucuacuccaccgucgccagcagccucgugcugguggucucccugggggccaucagcuucuggaugugcuccaacggcagccuccagugccgcaucugcaucuga

SEQ ID NO: 73098 - RNA, 1701 nt, Artificial Sequence
  derived and/or modified sequence opt1 from hemagglutinin__InfluenzaA__AHZ35935
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagauguuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacaucccgagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacaagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 73099 - RNA, 1701 nt, Artificial Sequence; identical to SEQ ID NO: 73093
  derived and/or modified sequence opt1 from hemagglutinin__InfluenzaA__AHZ35946

SEQ ID NO: 73100 - RNA, 1701 nt, Artificial Sequence; identical to SEQ ID NO: 73088
  derived and/or modified sequence opt1 from hemagglutinin__InfluenzaA__AHZ35958

SEQ ID NO: 73101 - RNA, 1701 nt, Artificial Sequence; identical to SEQ ID NO: 73088
  derived and/or modified sequence opt1 from hemagglutinin__InfluenzaA__AHZ35980

SEQ ID NO: 73102 - RNA, 1701 nt, Artificial Sequence; identical to SEQ ID NO: 73088
  derived and/or modified sequence opt1 from hemagglutinin__InfluenzaA__AHZ35991

SEQ ID NO: 73103 - RNA, 1701 nt, Artificial Sequence; identical to SEQ ID NO: 73088
  derived and/or modified sequence opt1 from hemagglutinin__InfluenzaA__AHZ36002

SEQ ID NO: 73104 - RNA, 1701 nt, Artificial Sequence
  derived and/or modified sequence opt1 from hemagglutinin__InfluenzaA__AHZ36013
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaaccgcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgguucgagauguuccccaagacgagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccaccgccgaccagcagucccuguaccagaacgccgacgccuacguguucguggggacgagccgcuacuccaagaaguucaagcccgagaucgccauccggccgaagguccgcgaccaggagggccggaugaacuacuacuggacccugguggagcccggcgacaagaucaccuucgaggcgaccgggaaccucguggucccccgcuacgccuucgccauggagcggaacgccggcagcgggaucaucaucuccgacacgcccgugcacgacugcaacacgaccugccagaccccgaagggcgccaucaacaccagccugcccuuccagaacauccaccccaucaccaucggcaagugccccaaguacgugaaguccaccaagcugcgccucgcgaccgggcugcggaacgucccgagcauccagucccgcggccuguucggggccaucgccggcuucaucgagggcggguggacgggcaugguggacgggugguacggcuaccaccaccagaacgagcaggggagcggcuacgccgccgaccucaaguccacccagaacgcgaucgacaagaucaccaacaaggugaacagcgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcucccuggugcucguggucagccugggcgccaucagcuucuggaugugcuccaacgggagccugcagugccgcaucugcaucuga

SEQ ID NO: 73105 - RNA, 1701 nt, Artificial Sequence
  derived and/or modified sequence opt1 from hemagglutinin__InfluenzaA__AHZ36024
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaccuaccagauccuggcgaucuacuccacggucgccagcucccuggugcucguggucagccugggggccaucagcuucuggaugugcuccaacggcagccugcagugccggaucugcaucuga

SEQ ID NO: 73106 - RNA, 1701 nt, Artificial Sequence
  derived and/or modified sequence opt1 from hemagglutinin__InfluenzaA__AHZ36035
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugauccagagcuccagcaccggggagaucugcaacagcccccaccagauccucgacggcgagaacugcacccugaucgacgcccugcucggggacccccagugcgacggcuuccagaacaagaagugggaccuguucgucgagcgcagcaaggcccacuccaacugcuaccccuacgacgugccggacuacgcgagccugcggucccucguggccagcuccggcacgcuggaguucaacaacgagagcuucaacuggaccggggucacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccgccgggcggaucaccgucagcacgaagcgcucccagcaggccgugaucccgaacaucggcagccggccccgcgugcggaacauccccagccgcgucuccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgcgggguucaucgagaacggcugggagggcaugguggacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgcggagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgcgaucuccugcuuccuccugugcguggcccugcucggcuucaucaugugggccugccagaaggggaacauccggugcaacaucugcaucuga

SEQ ID NO: 73107 - RNA, 1701 nt, Artificial Sequence; identical to SEQ ID NO: 67863
  derived and/or modified sequence opt1 from hemagglutinin__InfluenzaA__AHZ36047

SEQ ID NO: 73108 - RNA, 1701 nt, Artificial Sequence; identical to SEQ ID NO: 73088
  derived and/or modified sequence opt1 from hemagglutinin__InfluenzaA__AHZ36059

SEQ ID NO: 73109 - RNA, 1701 nt, Artificial Sequence; identical to SEQ ID NO: 73105
  derived and/or modified sequence opt1 from hemagglutinin__InfluenzaA__AHZ36070

SEQ ID NO: 73110 - RNA, 1701 nt, Artificial Sequence; identical to SEQ ID NO: 73104
  derived and/or modified sequence opt1 from hemagglutinin__InfluenzaA__AHZ36081

SEQ ID NO: 73111 - RNA, 1701 nt, Artificial Sequence; identical to SEQ ID NO: 73105
  derived and/or modified sequence opt1 from hemagglutinin__InfluenzaA__AHZ36092

SEQ ID NO: 73112 - RNA, 1701 nt, Artificial Sequence; identical to SEQ ID NO: 73088
  derived and/or modified sequence opt1 from hemagglutinin__InfluenzaA__AHZ36103

SEQ ID NO: 73113 - RNA, 1701 nt, Artificial Sequence; identical to SEQ ID NO: 73105
  derived and/or modified sequence opt1 from hemagglutinin__InfluenzaA__AHZ36114

SEQ ID NO: 73114 - RNA, 1701 nt, Artificial Sequence; identical to SEQ ID NO: 73088
  derived and/or modified sequence opt1 from hemagglutinin__InfluenzaA__AHZ36125

SEQ ID NO: 73115 - RNA, 1701 nt, Artificial Sequence; identical to SEQ ID NO: 73088
  derived and/or modified sequence opt1 from hemagglutinin__InfluenzaA__AHZ36136

SEQ ID NO: 73116 - RNA, 1701 nt, Artificial Sequence; identical to SEQ ID NO: 67863
  derived and/or modified sequence opt1 from hemagglutinin__InfluenzaA__AHZ36147

SEQ ID NO: 73117 - RNA, 1701 nt, Artificial Sequence
  derived and/or modified sequence opt1 from hemagglutinin__InfluenzaA__AHZ36158
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagauguuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgccacccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 73118 - RNA, 1701 nt, Artificial Sequence; identical to SEQ ID NO: 73088
  derived and/or modified sequence opt1 from hemagglutinin__InfluenzaA__AHZ36169

SEQ ID NO: 73119 - RNA, 1701 nt, Artificial Sequence
  derived and/or modified sequence opt1 from hemagglutinin__InfluenzaA__AHZ36180
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagauguuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccauccacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgugccgagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacaagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 73120 - RNA, 1701 nt, Artificial Sequence; identical to SEQ ID NO: 73093
  derived and/or modified sequence opt1 from hemagglutinin__InfluenzaA__AHZ36191

SEQ ID NO: 73121 - RNA, 1701 nt, Artificial Sequence; identical to SEQ ID NO: 67863
  derived and/or modified sequence opt1 from hemagglutinin__InfluenzaA__AHZ36203

SEQ ID NO: 73122 - RNA, 1701 nt, Artificial Sequence; identical to SEQ ID NO: 73088
  derived and/or modified sequence opt1 from hemagglutinin__InfluenzaA__AHZ36215

SEQ ID NO: 73123 - RNA, 1701 nt, Artificial Sequence; identical to SEQ ID NO: 67863
  derived and/or modified sequence opt1 from hemagglutinin__InfluenzaA__AHZ36226

SEQ ID NO: 73124 - RNA, 1701 nt, Artificial Sequence; identical to SEQ ID NO: 73088
  derived and/or modified sequence opt1 from hemagglutinin__InfluenzaA__AHZ36238

SEQ ID NO: 73125 - RNA, 1701 nt, Artificial Sequence; identical to SEQ ID NO: 73088
  derived and/or modified sequence opt1 from hemagglutinin__InfluenzaA__AHZ36249

SEQ ID NO: 73126 - RNA, 1701 nt, Artificial Sequence
  derived and/or modified sequence opt1 from hemagglutinin__InfluenzaA__AHZ36260
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuucuccagcgacaacgggaccugcuaccccggcgacuucaucaacuacgaggagcuccgggagcagcuguccagcguguccagcuucgagcgcuucgagauguuccccaagacguccagcuggcccaaccacgacuccaacaagggcgucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccaccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucucccugggggccaucagcuucuggaugugcagcaacggcucccugcagugccggaucugcaucuga

SEQ ID NO: 73127 - RNA, 1701 nt, Artificial Sequence; identical to SEQ ID NO: 73073
  derived and/or modified sequence opt1 from hemagglutinin__InfluenzaA__AHZ36271

SEQ ID NO: 73128 - RNA, 1701 nt, Artificial Sequence; identical to SEQ ID NO: 73088
  derived and/or modified sequence opt1 from hemagglutinin__InfluenzaA__AHZ36283

SEQ ID NO: 73129 - RNA, 1701 nt, Artificial Sequence; identical to SEQ ID NO: 73073
  derived and/or modified sequence opt1 from hemagglutinin__InfluenzaA__AHZ36294

SEQ ID NO: 73130 - RNA, 1701 nt, Artificial Sequence
  derived and/or modified sequence opt1 from hemagglutinin__InfluenzaA__AHZ36306
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagauguuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaagaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 73131 - RNA, 1701 nt, Artificial Sequence; identical to SEQ ID NO: 73088
  derived and/or modified sequence opt1 from hemagglutinin__InfluenzaA__AHZ36317

SEQ ID NO: 73132 - RNA, 1701 nt, Artificial Sequence; identical to SEQ ID NO: 73088
  derived and/or modified sequence opt1 from hemagglutinin__InfluenzaA__AHZ36328

SEQ ID NO: 73133 - RNA, 1701 nt, Artificial Sequence
  derived and/or modified sequence opt1 from hemagglutinin__InfluenzaA__AHZ36339
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagauguuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccgugaacaccagccugcccuuccagaacauccaccccaucaccaucgggaagugccccaaguacgucaaguccaccaagcugcggcucgcgaccggccugcgcaacgugccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggucaacagcgugaucgagaagaugaacacccaguucacggccgucggcaaggaguucaaccaccuggagcgccggaucgagaaccugaacaagaagguggacgacggcuuccucgacaucuggaccuacaacgccgagcugcuggugcuccuggagaacgagcgcacccuggacuaccacgacuccaacgucaagaaccucuacgagaaggugcggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcucgagagcacccggaucuaccagauccuggcgaucuacuccaccguggccagcucccuggugcucgucgugagccugggggccaucagcuucuggaugugcuccaacggcagccugcagugccgcaucugcaucuga

SEQ ID NO: 73134 - RNA, 1701 nt, Artificial Sequence
  derived and/or modified sequence opt1 from hemagglutinin__InfluenzaA__AHZ36362
augaaggccauccuggugguccuccuguacaccuucgccaucgcgaacgccgacacccugugcaucggcuaccacgccaacaacagcacggacaccguggacaccgugcucgagaagaacgucaccgugacgcacuccaucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacgggaccugcuaccccggcgacuucaucaacuacgaggagcuccgggagcagcugagcuccgugagcuccuucgagcgcuucgagauguuccccaagacgagcuccuggcccaaccacgacagcaacaagggcgugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccaccgccgaccagcagucccuguaccagaacgccgacgccuacgucuucgugggcacgagccgguacuccaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgcccguccacgacugcaacacgaccugccagaccccgaagggcgccgugaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagcgccggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcucccuggugcucguggucagccugggggccaucagcuucuggaugugcuccaacggcagccugcagugccgcaucugcaucuga

SEQ ID NO: 73135 - RNA, 1701 nt, Artificial Sequence
  derived and/or modified sequence opt1 from hemagglutinin__InfluenzaA__AHZ36385
augaagaccaucaucgcccugagcuacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagagcuccagcaccggggagaucugcaacagcccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgagccugcggucccugguggccagcuccggcacgcucgaguucaacaacgagagcuucaacuggaccggcgucacccagaacgggaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccagcggccggaucaccgucuccacgaagcgcagccagcaggccgugaucccgaacaucgggagccggccccgcgugcggaacauccccucccgcgucagcaucuacuggaccaucgugaagcccggcgacauccugcugaucaacuccaccggcaaccucaucgccccgcggggguacuucaagauccgcagcggcaaguccagcaucaugcgguccgacgcccccaucgggaagugcaacagcgcgugcaucacccccaacggcuccauccccaacgacaagccguuccagaacgugaaccgcaucacguacggcgccugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacagcgagggccgggggcaggcggccgaccucaaguccacgcaggccgccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacgacgucuaccgggacgaggcccugaacaaccgcuucaagaucaagggcguggagcucaagagcggguacaaggacuggauccuguggaucuccuucgccaucagcugcuuccugcucugcguggcgcugcugggcuucaucaugugggccugccagaagggcaacauccggugcaacaucugcaucuga

SEQ ID NO: 73136 - RNA, 1701 nt, Artificial Sequence
  derived and/or modified sequence opt1 from hemagglutinin__InfluenzaA__AHZ36397
augaagaccaucaucgcccugagcuacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagagcuccagcaccggggagaucugcaacagcccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgagccugcggucccugguggccagcuccggcacgcucgaguucaacaacgagagcuucaacuggaccggcgucacccagaacgggaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccagcggccggaucaccgucuccacgaagcgcagccagcaggccgugaucccgaacaucgggagccggccccgcgugcggaacauccccucccgcgucagcaucuacuggaccaucgugaagcccggcgacauccugcugaucaacuccaccggcaaccucaucgccccgcggggguacuucaagauccgcagcggcaaguccagcaucaugcgguccgacgcccccaucgggaagugcaacagcgcgugcaucacccccaacggcuccauccccaacgacaagccguuccagaacgugaaccgcaucacguacggcgccugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacagcgagggccgggggcaggcggccgaccucaaguccacgcaggccgccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacaacgucuaccgggacgaggcccugaacaaccgcuucaagaucaagggcguggagcucaagagcggguacaaggacuggauccuguggaucuccuucgccaucagcugcuuccugcucugcguggcgcugcugggcuucaucaugugggccugccagaagggcaacauccggugcaacaucugcaucuga

SEQ ID NO: 73137 - RNA, 1701 nt, Artificial Sequence; identical to SEQ ID NO: 73073
  derived and/or modified sequence opt1 from hemagglutinin__InfluenzaA__AHZ36409

SEQ ID NO: 73138 - RNA, 1701 nt, Artificial Sequence; identical to SEQ ID NO: 73074
  derived and/or modified sequence opt1 from hemagglutinin__InfluenzaA__AHZ36433

SEQ ID NO: 73139 - RNA, 1701 nt, Artificial Sequence
  derived and/or modified sequence opt1 from hemagglutinin__InfluenzaA__AHZ36445
augaagaccaucaucgcccugagcuacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagagcuccagcaccggggagaucugcaacagcccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgagccugcggucccugguggccagcuccggcacgcucgaguucaacaacgagagcuucaacuggaccggcgucacccagaacgggaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccagcggccggaucaccgucuccacgaagcgcagccagcaggccgugaucccgaacaucgggagccggccccgcgugcggaacauccccucccgcgucagcaucuacuggaccaucgugaagcccggcgacauccugcugaucaacuccaccggcaaccucaucgccccgcggggguacuucaagauccgcagcggcaaguccagcaucaugcgguccgacgcccccaucgggaagugcaacagcgcgugcaucacccccaacggcuccauccccaacgacaagccguuccagaacgugaaccgcaucacguacggcgccugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacagcgagggccgggggcaggcggccgaccucaaguccacgcaggccgccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacgacgccugcaucggcuccauccgcaacgggaccuacgaccacgacgucuaccgggacgaggcccugaacaaccgcuuccagaucaagggcguggagcucaagagcggguacaaggacuggauccuguggaucuccuucgccaucagcugcuuccugcucugcguggcgcugcugggcuucaucaugugggccugccagaagggcaacauccggugcaacaucugcaucuga

SEQ ID NO: 73140 - RNA, 1701 nt, Artificial Sequence; identical to SEQ ID NO: 73073
  derived and/or modified sequence opt1 from hemagglutinin__InfluenzaA__AHZ36457

SEQ ID NO: 73141 - RNA, 1701 nt, Artificial Sequence; identical to SEQ ID NO: 73073
  derived and/or modified sequence opt1 from hemagglutinin__InfluenzaA__AHZ36469

SEQ ID NO: 73142 - RNA, 1701 nt, Artificial Sequence
  derived and/or modified sequence opt1 from hemagglutinin__InfluenzaA__AHZ36481
augaagaccaucaucgcccugagcuacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagagcuccagcaccggggagaucugcaacagcccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgagccugcggucccugguggccagcuccggcacgcucgaguucaacaacgagagcuucaacuggaccggcgucacccagaacgggaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccagcggccggaucaccgucuccacgaagcgcagccagcaggccgugaucccgaacaucgggagccggccccgcgugcggaacauccccucccgcgucagcaucuacuggaccaucgugaagcccggcgacauccugcugaucaacuccaccggcaaccucaucgccccgcggggguacuucaagauccgcaacggcaagagcuccaucaugcggagcgacgcccccaucgggaagugcaacuccgcgugcaucacccccaacggcagcauccccaacgacaagccguuccagaacgugaaccgcaucacguacggcgccugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacuccgagggccgggggcaggcggccgaccucaagagcacgcaggccgccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcgcuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgccugcaucggcagcauccgcaacgggaccuacgaccacgacgucuaccgggacgaggcccugaacaaccgcuuccagaucaagggcguggagcucaaguccggguacaaggacuggauccuguggaucagcuucgccaucuccugcuuccugcucugcguggcgcugcugggcuucaucaugugggccugccagaagggcaacauccggugcaacaucugcaucuga

SEQ ID NO: 73143 - RNA, 1701 nt, Artificial Sequence; identical to SEQ ID NO: 73074
  derived and/or modified sequence opt1 from hemagglutinin__InfluenzaA__AHZ36493

SEQ ID NO: 73144 - RNA, 1701 nt, Artificial Sequence; identical to SEQ ID NO: 73074
  derived and/or modified sequence opt1 from hemagglutinin__InfluenzaA__AHZ36505

SEQ ID NO: 73145 - RNA, 1701 nt, Artificial Sequence; identical to SEQ ID NO: 73074
  derived and/or modified sequence opt1 from hemagglutinin__InfluenzaA__AHZ36517

SEQ ID NO: 73146 - RNA, 1701 nt, Artificial Sequence
  derived and/or modified sequence opt1 from hemagglutinin__InfluenzaA__AHZ36529
augaagaccaucaucgcccugagcuacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagagcuccagcaccggggagaucugcaacagcccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgagccugcggucccugguggccagcuccggcacgcucgaguucaacaacgagagcuucaacuggaccggcgucacccagaacgggaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccagcggccggaucaccgucuccacgaagcgcagccagcaggccgugaucccgaacaucgggagccggccccgcgugcggaacauccccucccgcgucagcaucuacuggaccaucgugaagcccggcgacauccugcugaucaacuccaccggcaaccucaucgccccgcggggguacuucaagauccgcagcggcaaguccagcaucaugcgguccgacgcccccaucgggaagugcaacagcuccugcaucacccccaacggcagcauccccaacgacaagccguuccagaacgugaaccgcaucacguacggcgcgugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacuccgagggccgggggcaggccgcggaccucaagagcacgcaggccgccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacaugggcaacgggugcuucaagaucuaccacaagugcgacaacgccugcaucggcagcauccgcaacgggaccuacgaccacgacgucuaccgggacgaggcccugaacaaccgcuuccagaucaagggcguggagcucaaguccggguacaaggacuggauccuguggaucagcuucgccaucuccugcuuccugcucugcguggcccugcugggcuucaucaugugggcgugccagaagggcaacauccggugcaacaucugcaucuga

SEQ ID NO: 73147 - RNA, 1701 nt, Artificial Sequence; identical to SEQ ID NO: 73073
  derived and/or modified sequence opt1 from hemagglutinin__InfluenzaA__AHZ36541

SEQ ID NO: 73148 - RNA, 1701 nt, Artificial Sequence
  derived and/or modified sequence opt1 from hemagglutinin__InfluenzaA__AHZ36553
augaagaccaucaucgcccugagcuacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagagcuccagcaccggggagaucugcaacagcccccaccagauccuggacggcgagaacugcacccucaucgacgcccugcugggggacccccagugcgacgacuuccagaacaaggagugggaccucuucgucgagcgcuccaaggcccacuccaacugcuaccccuacgacgugccggacuacgcgagccugcggucccugguggccagcuccggcacgcucgaguucaagaacgagagcuucaacuggaccggcgucacccagaacgggaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccagcggccggaucaccgucuccacgaagcgcagccagcaggccgugaucccgaacaucgggagccggccccgcgugcggaacauccccucccgcgucagcaucuacuggaccaucgugaagcccggcgacauccugcugaucaacuccaccggcaaccucaucgccccgcggggguacuucaagauccgcagcggcaaguccagcaucaugcgguccgacgcccccaucgggaagugcaacagcgcgugcaucacccccaacggcuccauccccaacgacaagccguuccagaacgugaaccgcaucacguacgggaccugcccccgguacgucaagcagaacacccugaagcuggccaccggcaugcgcaacgugcccgagaagcagacgcggggcaucuucggggccaucgccggcuucaucgagaacgggugggagggcaugguggacggcugguacggguuccgccaccagaacagcgagggccgggggcaggccgcggaccucaaguccacccaggccgccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagagcggguacaaggacuggauccuguggaucuccuucgccaucagcugcuuccugcucugcguggcccugcugggcuucaucaugugggcgugccagaagggcaacauccggugcaacaucugcaucuga

SEQ ID NO: 73149 - RNA, 1701 nt, Artificial Sequence; identical to SEQ ID NO: 73073
  derived and/or modified sequence opt1 from hemagglutinin__InfluenzaA__AHZ36565

SEQ ID NO: 73150 - RNA, 1701 nt, Artificial Sequence; identical to SEQ ID NO: 73073
  derived and/or modified sequence opt1 from hemagglutinin__InfluenzaA__AHZ36577

SEQ ID NO: 73151 - RNA, 1701 nt, Artificial Sequence; identical to SEQ ID NO: 73073
  derived and/or modified sequence opt1 from hemagglutinin__InfluenzaA__AHZ36589

SEQ ID NO: 73152 - RNA, 1701 nt, Artificial Sequence; identical to SEQ ID NO: 73148
  derived and/or modified sequence opt1 from hemagglutinin__InfluenzaA__AHZ36601

SEQ ID NO: 73153 - RNA, 1701 nt, Artificial Sequence
  derived and/or modified sequence opt1 from hemagglutinin__InfluenzaA__AHZ36613
augaagaccaucaucgcccugagcuacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagagcuccagcaccggggagaucugcaacagcccccaccagauccuggacggcgagaacugcacccucaucgacgcccugcugggggacccccagugcgacgacuuccagaacaaggagugggaccucuucgucgagcgcuccaaggcccacuccaacugcuaccccuacgacgugccggacuacgcgagccugcggucccugguggccagcuccggcacgcucgaguucaacaacgagagcuucaacuggaccggcgucacccagaacgggaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccagcggccggaucaccgucuccacgaagcgcagccagcaggccgugaucccgaacaucgggagccggccccgcgugcggaacauccccucccgcgucagcaucuacuggaccaucgugaagcccggcgacauccugcugaucaacuccaccggcaaccucaucgccccgcggggguacuucaagauccgcagcggcaaguccagcaucaugcgguccgacgcccccaucgggaagugcaacagcgcgugcaucacccccaacggcuccauccccaacgacaagccguuccagaacgugaaccgcaucacguacgggaccugcccccgguacgucaagcagaacacccugaagcuggccaccggcaugcgcaacgugcccgagaagcagacgcggggcaucuucggggccaucgccggcuucaucgagaacgggugggagggcaugguggacggcugguacggguuccgccaccagaacagcgagggccgggggcaggccgcggaccucaaguccacccaggccgccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagagcggguacaaggacuggauccuguggaucuccuucgccacgagcugcuuccugcucugcguggcccugcugggcuucaucaugugggcgugccagaagggcaacauccggugcaacaucugcaucuga

SEQ ID NO: 73154 - RNA, 1701 nt, Artificial Sequence; identical to SEQ ID NO: 73073
  derived and/or modified sequence opt1 from hemagglutinin__InfluenzaA__AHZ36625

SEQ ID NO: 73155 - RNA, 1701 nt, Artificial Sequence; identical to SEQ ID NO: 73074
  derived and/or modified sequence opt1 from hemagglutinin__InfluenzaA__AHZ36637

SEQ ID NO: 73156 - RNA, 1701 nt, Artificial Sequence; identical to SEQ ID NO: 73074
  derived and/or modified sequence opt1 from hemagglutinin__InfluenzaA__AHZ36649

SEQ ID NO: 73157 - RNA, 1701 nt, Artificial Sequence; identical to SEQ ID NO: 71002
  derived and/or modified sequence opt1 from hemagglutinin__InfluenzaA__AHZ36661

SEQ ID NO: 73158 - RNA, 1701 nt, Artificial Sequence; identical to SEQ ID NO: 71002
  derived and/or modified sequence opt1 from hemagglutinin__InfluenzaA__AHZ36673

SEQ ID NO: 73159 - RNA, 1701 nt, Artificial Sequence
  derived and/or modified sequence opt1 from hemagglutinin__InfluenzaA__AHZ36685
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagcgggucgagcucaagagcggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 73160 - RNA, 1683 nt, Artificial Sequence; identical to SEQ ID NO: 70996
  derived and/or modified sequence opt1 from hemagglutinin__InfluenzaA__AHZ39698

SEQ ID NO: 73161 - RNA, 1683 nt, Artificial Sequence
  derived and/or modified sequence opt1 from hemagglutinin__InfluenzaA__AHZ39722
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccgacggcgccaccagcgccugccggcgcuccgggagcuccuucuacgccgagaugaaguggcugcugagcaacacggacgacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucaccuucagcuucaacggcgcguucaucgcccccgaccgcgccuccuuccuccggggcaagagcauggggauccaguccggcguccagguggacgccaacugcgagggggacugcuaccacagcggcgggacgaucaucuccaaccugcccuuccagaacaucgacagccgcgccgugggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgcgaucgugauggggcuggucuucaucugcgugaagaacggcaacaugcgcugcaccaucugcaucuga

SEQ ID NO: 73162 - RNA, 1683 nt, Artificial Sequence; identical to SEQ ID NO: 73161
  derived and/or modified sequence opt1 from hemagglutinin__InfluenzaA__AHZ39734

SEQ ID NO: 73163 - RNA, 1683 nt, Artificial Sequence
  derived and/or modified sequence opt1 from hemagglutinin__InfluenzaA__AHZ39746
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggagcggccccaggugaacggccucagcgggcggaucgacuuccacuggcugaugcugaaccccaacgacaccgucaccuucagcuucaacggcgccuucaucgcgcccgaccgcgccuccuuccuccggggcaagagcauggggauccaguccggcguccagguggacgccaacugcgagggggacugcuaccacagcggcgggacgaucaucuccaaccugcccuuccagaacaucgacagccgcgccgugggcaagugcccgcgguacgugaagcagcgcucccugcuccuggccaccgggaugaagaacgugcccgagauccccaagggccggggccuguucggggcgaucgccggcuucaucgagaacgggugggagggccucaucgacgggugguacggcuuccgccaccagaacgcccagggcgaggggaccgccgccgacuacaagagcacccaguccgcgaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgccgaggaggacggcaccggcugcuucgagaucuuccacaagugcgacgacgacugcauggcguccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgccaucgugauggggcuggucuucaucugcgugaagaacggcaacaugcgcugcaccaucugcaucuga

SEQ ID NO: 73164 - RNA, 1683 nt, Artificial Sequence; identical to SEQ ID NO: 73161
  derived and/or modified sequence opt1 from hemagglutinin__InfluenzaA__AHZ39758

SEQ ID NO: 73165 - RNA, 1683 nt, Artificial Sequence; identical to SEQ ID NO: 73161
  derived and/or modified sequence opt1 from hemagglutinin__InfluenzaA__AHZ39770

SEQ ID NO: 73166 - RNA, 1683 nt, Artificial Sequence; identical to SEQ ID NO: 73161
  derived and/or modified sequence opt1 from hemagglutinin__InfluenzaA__AHZ39782

SEQ ID NO: 73167 - RNA, 1701 nt, Artificial Sequence; identical to SEQ ID NO: 70891
  derived and/or modified sequence opt1 from hemagglutinin__InfluenzaA__AHZ39794

SEQ ID NO: 73168 - RNA, 1701 nt, Artificial Sequence; identical to SEQ ID NO: 71005
  derived and/or modified sequence opt1 from hemagglutinin__InfluenzaA__AHZ39806

SEQ ID NO: 73169 - RNA, 1701 nt, Artificial Sequence
  derived and/or modified sequence opt1 from hemagglutinin__InfluenzaA__AHZ39818
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccgccgggcggaucacggugagcaccaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacgcccaacggcagcauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgcgggguucaucgagaacggcugggagggcauggucgacgggugguacggcuuccgccaccagaacuccgaggggcggggccaggccgccgaccucaagagcacccaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgcggagcucaucgucgcccuggagaaccagcacacgaucgaccugaccgacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccugaacaaccgcuuccagaucaaggggguggagcucaaguccggcuacaaggacuggauccuguggaucagcuucgcgaucuccugcuuccugcucugcgucgugcugcugggcuucaucaugugggccugccagaaggggaacauccggugcaacaucugcaucuga

SEQ ID NO: 73170 - RNA, 1701 nt, Artificial Sequence; identical to SEQ ID NO: 70891
  derived and/or modified sequence opt1 from hemagglutinin__InfluenzaA__AHZ39841

SEQ ID NO: 73171 - RNA, 1701 nt, Artificial Sequence; identical to SEQ ID NO: 70911
  derived and/or modified sequence opt1 from hemagglutinin__InfluenzaA__AHZ39853

SEQ ID NO: 73172 - RNA, 1701 nt, Artificial Sequence; identical to SEQ ID NO: 70891
  derived and/or modified sequence opt1 from hemagglutinin__InfluenzaA__AHZ39865

SEQ ID NO: 73173 - RNA, 1701 nt, Artificial Sequence
  derived and/or modified sequence opt1 from hemagglutinin__InfluenzaA__AHZ39877
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaccagcugcuuccugcugugcguggcccugcucggcuucaucaugugggccugccagaaggggaacauccgcugcaacaucugcaucuga

SEQ ID NO: 73174 - RNA, 1701 nt, Artificial Sequence; identical to SEQ ID NO: 70911
  derived and/or modified sequence opt1 from hemagglutinin__InfluenzaA__AHZ39889

SEQ ID NO: 73175 - RNA, 1701 nt, Artificial Sequence; identical to SEQ ID NO: 70892
  derived and/or modified sequence opt1 from hemagglutinin__InfluenzaA__AHZ39913

SEQ ID NO: 73176 - RNA, 1701 nt, Artificial Sequence
  derived and/or modified sequence opt1 from hemagglutinin__InfluenzaA__AHZ39925
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcgacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 73177 - RNA, 1701 nt, Artificial Sequence; identical to SEQ ID NO: 70891
  derived and/or modified sequence opt1 from hemagglutinin__InfluenzaA__AHZ39937

SEQ ID NO: 73178 - RNA, 1701 nt, Artificial Sequence; identical to SEQ ID NO: 70891
  derived and/or modified sequence opt1 from hemagglutinin__InfluenzaA__AHZ39949

SEQ ID NO: 73179 - RNA, 1701 nt, Artificial Sequence; identical to SEQ ID NO: 70891
  derived and/or modified sequence opt1 from hemagglutinin__InfluenzaA__AHZ39961

SEQ ID NO: 73180 - RNA, 1701 nt, Artificial Sequence; identical to SEQ ID NO: 70891
  derived and/or modified sequence opt1 from hemagglutinin__InfluenzaA__AHZ39973

SEQ ID NO: 73181 - RNA, 1701 nt, Artificial Sequence
  derived and/or modified sequence opt1 from hemagglutinin__InfluenzaA__AHZ39985
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgccuccaucgggaagugcaagagcgagugcaucacccccaacggcuccauccccaacgacaagcccuuccagaacgugaaccggaucaccuacggggccugcccgcgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaccagcugcuuccuccugugcguggcccugcucggcuucaucaugugggccugccagaaggggaacauccgcugcaacaucugcaucuga

SEQ ID NO: 73182 - RNA, 1701 nt, Artificial Sequence; identical to SEQ ID NO: 70891
  derived and/or modified sequence opt1 from hemagglutinin__InfluenzaA__AHZ39997

SEQ ID NO: 73183 - RNA, 1701 nt, Artificial Sequence
  derived and/or modified sequence opt1 from hemagglutinin__InfluenzaA__AHZ40009
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaucagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccgcaagagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 73184 - RNA, 1701 nt, Artificial Sequence; identical to SEQ ID NO: 70891
  derived and/or modified sequence opt1 from hemagglutinin__InfluenzaA__AHZ40021

SEQ ID NO: 73185 - RNA, 1701 nt, Artificial Sequence; identical to SEQ ID NO: 70866
  derived and/or modified sequence opt1 from hemagglutinin__InfluenzaA__AHZ40033

SEQ ID NO: 73186 - RNA, 1701 nt, Artificial Sequence; identical to SEQ ID NO: 70891
  derived and/or modified sequence opt1 from hemagglutinin__InfluenzaA__AHZ40045

SEQ ID NO: 73187 - RNA, 1701 nt, Artificial Sequence; identical to SEQ ID NO: 70891
  derived and/or modified sequence opt1 from hemagglutinin__InfluenzaA__AHZ40060

SEQ ID NO: 73188 - RNA, 1701 nt, Artificial Sequence; identical to SEQ ID NO: 70891
  derived and/or modified sequence opt1 from hemagglutinin__InfluenzaA__AHZ40072

SEQ ID NO: 73189 - RNA, 1701 nt, Artificial Sequence; identical to SEQ ID NO: 70891
  derived and/or modified sequence opt1 from hemagglutinin__InfluenzaA__AHZ40084

SEQ ID NO: 73190 - RNA, 1701 nt, Artificial Sequence; identical to SEQ ID NO: 70891
  derived and/or modified sequence opt1 from hemagglutinin__InfluenzaA__AHZ40096

SEQ ID NO: 73191 - RNA, 1701 nt, Artificial Sequence; identical to SEQ ID NO: 70892
  derived and/or modified sequence opt1 from hemagglutinin__InfluenzaA__AHZ40108

SEQ ID NO: 73192 - RNA, 1701 nt, Artificial Sequence; identical to SEQ ID NO: 71005
  derived and/or modified sequence opt1 from hemagglutinin__InfluenzaA__AHZ40120

SEQ ID NO: 73193 - RNA, 1701 nt, Artificial Sequence
  derived and/or modified sequence opt1 from hemagglutinin__InfluenzaA__AHZ40130
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaagaacuggauccuguggaucuccuucgccaucagcugcuuccugcugugcguggcccugcucggcuucaucaugugggccugccagaaggggaacauccgcugcaacaucugcaucuga

SEQ ID NO: 73194 - RNA, 1701 nt, Artificial Sequence
  derived and/or modified sequence opt1 from hemagglutinin__InfluenzaA__AHZ40142
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccaggacaagaagugggaccuguucguggagcgguccaaggccuacagcaacugcuaccccuacgacgugccggacuacgcgucccugcgcagccucgucgccuccagcggcacccuggaguucaacaacgagaacuucaacuggacgggggugacccagaacggcaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgaccggccguuccagaacgugaaccgcaucaccuacggggccugcccccgguacgugaagcagagcacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgggagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 73195 - RNA, 1701 nt, Artificial Sequence
  derived and/or modified sequence opt1 from hemagglutinin__InfluenzaA__AHZ40154
augaagaccaucaucgcccugagcuacauccucugccugggcuucgcccaggagcugcccgggaacgacaacuccaccgcgacgcucugccugggccaccacgccgugccgaacgggaccaucgucaagaccaucaccaacgaccagaucgaggugacgaacgccaccgagcuggugcagagcuccagcaccggcgagaucugcaacagcccccaccagauccucgacggggagaacugcacccugaucgacgcccugcucggcgacccccagugcgacggcuuccagaacaagaagugggaccuguucgucgagcgcagcaaggcccacuccaacugcuaccccuacgacgugccggacuacgcgagccugcggucccucguggccagcuccgggacgcuggaguucaacaacgagagcuucaacuggaccggcgucacccagaacgggaccuccagcgccugcauccgcggcuccaacaacagcuucuucucccggcugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccagcggccgcaucaccgucuccacgaagcggagccagcaggccgugaucccgaacaucgggagccgcccccgggugcgcaacauccccucccgggucagcaucuacuggaccaucgugaagcccggcgacaugcugcucaucaacuccaccgggaaccugaucgccccgcgcggcuacuucaagauccggagcggcaaguccagcaucaugcgcuccgacgcccccaucgggaagugcaacagcgcgugcaucacccccaacggcuccauccccaacgacaagccguuccagaacgugaaccggaucacguacggggccugcccccgcuacgucaagcagaacacccugaagcucgccaccggcaugcggaacgugcccgagaagcagacccgcgggaucuucggcgccaucgccggcuucaucgagaacgggugggagggcaugguggacgggugguacggcuuccggcaccagaacagcgaggggcgcggccaggcggccgaccugaaguccacgcaggccgccaucgaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgggagaacgccgaggacauggggaacggcugcuucaagaucuaccacaagugcaacaacgccugcaucggguccauccgcaacggcaccuacgaccacgacgucuaccgcgacgaggcccucaacaaccgguuccagaucaagggcguggagcugaaguccggguacaaggacuggauccuguggaucuccuucgccaucagcugcuuccuccugugcguggcgcugcucggcuucaucaugugggccugccagaaggggaacauccgcugcaacaucugcaucuga

SEQ ID NO: 73196 - RNA, 1701 nt, Artificial Sequence
  derived and/or modified sequence opt1 from hemagglutinin__InfluenzaA__AHZ40166
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccggagggcgccaucaacaccagccugcccuuccagaacauccaccccaucaccaucgggcggugccccaaguacgugaaguccaccaagcugcgccucgcgacgggccugcggaacgugccgagcauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgagaagaucgacggcgugaagcucgagagcacccggaucuaccagauccuggcgaucuacuccaccguggccagcucccugguccucguggugagccugggggccaucagcuucuggaugugcuccaacggcagccugcagugccgcaucugcaucuga

SEQ ID NO: 73197 - RNA, 1701 nt, Artificial Sequence; identical to SEQ ID NO: 70891
  derived and/or modified sequence opt1 from hemagglutinin__InfluenzaA__AHZ40177

SEQ ID NO: 73198 - RNA, 1701 nt, Artificial Sequence; identical to SEQ ID NO: 70891
  derived and/or modified sequence opt1 from hemagglutinin__InfluenzaA__AHZ40189

SEQ ID NO: 73199 - RNA, 1701 nt, Artificial Sequence; identical to SEQ ID NO: 70891
  derived and/or modified sequence opt1 from hemagglutinin__InfluenzaA__AHZ40201

SEQ ID NO: 73200 - RNA, 1701 nt, Artificial Sequence; identical to SEQ ID NO: 70876
  derived and/or modified sequence opt1 from hemagglutinin__InfluenzaA__AHZ40213

SEQ ID NO: 73201 - RNA, 1701 nt, Artificial Sequence; identical to SEQ ID NO: 70843
  derived and/or modified sequence opt1 from hemagglutinin__InfluenzaA__AHZ40225

SEQ ID NO: 73202 - RNA, 1701 nt, Artificial Sequence
  derived and/or modified sequence opt1 from hemagglutinin__InfluenzaA__AHZ40237
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacugggccggggugacgcagaacggcaccagcuccgccugcauccgcgggagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggagccagcaggccgugaucccgaacaucggcucccgcccccggauccgcaacauccccagccggaucuccaucuacuggaccaucgucaagcccggggacauccugcucaucaacagcacgggcaaccugaucgccccgcgcggguacuucaagauccgguccggcaagagcuccaucaugcgcagcgacgcccccaucggcaagugcaaguccgagugcaucacccccaacgggagcauccccaccgacaagccguuccagaacgugaaccggaucaccuacggcgcgugcccccgcuacgugaagcaguccacgcugaagcucgccaccgggaugcggaacguccccgagaagcagacccgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgggagaacgcggaggacaugggcaacgggugcuucaagaucuaccacaagugcgacaacgccugcaucggcuccauccgcaacgggaccuacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 73203 - RNA, 1701 nt, Artificial Sequence; identical to SEQ ID NO: 70899
  derived and/or modified sequence opt1 from hemagglutinin__InfluenzaA__AHZ40249

SEQ ID NO: 73204 - RNA, 1701 nt, Artificial Sequence; identical to SEQ ID NO: 70866
  derived and/or modified sequence opt1 from hemagglutinin__InfluenzaA__AHZ40261

SEQ ID NO: 73205 - RNA, 1701 nt, Artificial Sequence; identical to SEQ ID NO: 71005
  derived and/or modified sequence opt1 from hemagglutinin__InfluenzaA__AHZ40273

SEQ ID NO: 73206 - RNA, 1701 nt, Artificial Sequence
  derived and/or modified sequence opt1 from hemagglutinin__InfluenzaA__AHZ40285
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccgacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaguccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccagagcgggaaguccagcaucaugcgcuccgacacccccaucggcaagugcaacagcgagugcaucacgcccaacggcuccauccccaacgacaagccguuccagaacgugaaccggaucaccuacggggccugcccccgcuacgugaagcagaacacccugaagcucgccaccggcaugcggaacguccccgagaagcagacgcgcgggaucuucggcgcgaucgccggguucaucgagaacggcugggagggcaugguggacgggugguacggcuuccggcaccagaacagcgaggggcgcggccaggccgccgaccugaaguccacccaggccgcgaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgccugcaucggguccauccgcaacggcaccuacaaccacgacguguaccgcgacgaggcgcucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 73207 - RNA, 1701 nt, Artificial Sequence; identical to SEQ ID NO: 71002
  derived and/or modified sequence opt1 from hemagglutinin__InfluenzaA__AHZ40297

SEQ ID NO: 73208 - RNA, 1701 nt, Artificial Sequence
  derived and/or modified sequence opt1 from hemagglutinin__InfluenzaA__AHZ40309
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggaacggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggugcugcucggcuucaucaugugggccugccagaaggggaacauccgcugcaacaucugcaucuga

SEQ ID NO: 73209 - RNA, 1701 nt, Artificial Sequence; identical to SEQ ID NO: 70891
  derived and/or modified sequence opt1 from hemagglutinin__InfluenzaA__AHZ40321

SEQ ID NO: 73210 - RNA, 1701 nt, Artificial Sequence; identical to SEQ ID NO: 70891
  derived and/or modified sequence opt1 from hemagglutinin__InfluenzaA__AHZ40333

SEQ ID NO: 73211 - RNA, 1701 nt, Artificial Sequence
  derived and/or modified sequence opt1 from hemagglutinin__InfluenzaA__AHZ40345
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccuccgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 73212 - RNA, 1701 nt, Artificial Sequence; identical to SEQ ID NO: 70892
  derived and/or modified sequence opt1 from hemagglutinin__InfluenzaA__AHZ40357

SEQ ID NO: 73213 - RNA, 1701 nt, Artificial Sequence
  derived and/or modified sequence opt1 from hemagglutinin__InfluenzaA__AHZ40369
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccgggcgcagcuccaucaugcggagcgacgcccccaucggcaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 73214 - RNA, 1701 nt, Artificial Sequence; identical to SEQ ID NO: 71002
  derived and/or modified sequence opt1 from hemagglutinin__InfluenzaA__AHZ40381

SEQ ID NO: 73215 - RNA, 1701 nt, Artificial Sequence; identical to SEQ ID NO: 70891
  derived and/or modified sequence opt1 from hemagglutinin__InfluenzaA__AHZ40393

SEQ ID NO: 73216 - RNA, 1701 nt, Artificial Sequence; identical to SEQ ID NO: 70891
  derived and/or modified sequence opt1 from hemagglutinin__InfluenzaA__AHZ40405

SEQ ID NO: 73217 - RNA, 1701 nt, Artificial Sequence; identical to SEQ ID NO: 70891
  derived and/or modified sequence opt1 from hemagglutinin__InfluenzaA__AHZ40417

SEQ ID NO: 73218 - RNA, 1701 nt, Artificial Sequence
  derived and/or modified sequence opt1 from hemagglutinin__InfluenzaA__AHZ40429
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaagaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 73219 - RNA, 1701 nt, Artificial Sequence; identical to SEQ ID NO: 70891
  derived and/or modified sequence opt1 from hemagglutinin__InfluenzaA__AHZ40441

SEQ ID NO: 73220 - RNA, 1701 nt, Artificial Sequence; identical to SEQ ID NO: 71034
  derived and/or modified sequence opt1 from hemagglutinin__InfluenzaA__AHZ40453

SEQ ID NO: 73221 - RNA, 1701 nt, Artificial Sequence
  derived and/or modified sequence opt1 from hemagglutinin__InfluenzaA__AHZ40465
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacaugccggacuacgcgucccugcgcagccucguggccuccagcggcacccuggaguucaacaacgaguccuucaacuggacgggggucacccagaacggcaccagcuccgccugcauccggcgcagcaacuccagcuucuucucccggcugaacuggcucacccaccugaacuucaaguaccccgcccugaacgugacgaugcccaacaacgagcgcuucgacaagcucuacaucuggggcgugcaccaccccgggaccgacaaggaccagaucuuccuguacgcgcagagcuccgggcggaucaccgucagcaccaagcgcagccagcaggccgugaucccgaacaucggcucccggccccgcauccggaacauccccagccgcaucuccaucuacuggacgaucgugaagcccggcgacauccugcucaucaacagcaccgggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgucaaccgcaucaccuacggggccugcccccgguacgugaagcaguccacgcugaagcucgcgaccggcaugcgcaacgugcccgagaagcagacccgggggaucuucggcgccaucgccggguucaucgagaacggcugggagggcauggucgacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaaggggguggagcucaagagcggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 73222 - RNA, 1701 nt, Artificial Sequence; identical to SEQ ID NO: 70892
  derived and/or modified sequence opt1 from hemagglutinin__InfluenzaA__AHZ40477

SEQ ID NO: 73223 - RNA, 1701 nt, Artificial Sequence; identical to SEQ ID NO: 71068
  derived and/or modified sequence opt1 from hemagglutinin__InfluenzaA__AHZ40489

SEQ ID NO: 73224 - RNA, 1701 nt, Artificial Sequence; identical to SEQ ID NO: 70891
  derived and/or modified sequence opt1 from hemagglutinin__InfluenzaA__AHZ40500

SEQ ID NO: 73225 - RNA, 1701 nt, Artificial Sequence; identical to SEQ ID NO: 70891
  derived and/or modified sequence opt1 from hemagglutinin__InfluenzaA__AHZ40512

SEQ ID NO: 73226 - RNA, 1701 nt, Artificial Sequence
  derived and/or modified sequence opt1 from hemagglutinin__InfluenzaA__AHZ40524
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagcggcagacccgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 73227 - RNA, 1701 nt, Artificial Sequence; identical to SEQ ID NO: 72778
  derived and/or modified sequence opt1 from hemagglutinin__InfluenzaA__AHZ40536

SEQ ID NO: 73228 - RNA, 1701 nt, Artificial Sequence; identical to SEQ ID NO: 70891
  derived and/or modified sequence opt1 from hemagglutinin__InfluenzaA__AHZ40548

SEQ ID NO: 73229 - RNA, 1701 nt, Artificial Sequence; identical to SEQ ID NO: 70866
  derived and/or modified sequence opt1 from hemagglutinin__InfluenzaA__AHZ40572

SEQ ID NO: 73230 - RNA, 1701 nt, Artificial Sequence; identical to SEQ ID NO: 70866
  derived and/or modified sequence opt1 from hemagglutinin__InfluenzaA__AHZ40583

SEQ ID NO: 73231 - RNA, 1701 nt, Artificial Sequence
  derived and/or modified sequence opt1 from hemagglutinin__InfluenzaA__AHZ40595
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacgacgggaagcugugcaagcuccgcggcgucgcgccccugcaccuggggaagugcaacaucgccggcuggauccucgggaacccggagugcgagagccuguccaccgccagcuccuggagcuacaucguggagaccuccggcagcgacaacggcacgugcuaccccggggacuucaucgacuacgaggagcugcgggagcagcucuccagcguguccagcuucgagcgcuucgagaucuuccccaagaccuccagcuggcccaaccacgacuccaacaagggcgucaccgccgccugcccgcacgccggggcgaagggcuucuacaagaaccugaucuggcuggugaagaaggggaacagcuaccccaagcucuccaucagcuacaucaacgacaagggcaaggaggugcugguccuguggggcauccaccaccccuccaccacggccgaccagcagagccucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccaugaagcgcaacgccggcagcgggaucaucaucuccgacacccccgugcacgacugcaacaccacgugccagaccccgaagggcgccaucaacaccagccuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcagcggcuacgccgccgaccugaaguccacccagaacgccaucgacaagaucacgaacaaggugaacagcgucaucgagaagaugaacacccaguucaccgcgguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgccaucuacuccaccgcggccagcucccugguccugguggugagccucggcgccaucuccuucuggaugugcagcaacgggagccugcagugccggaucugcaucuga

SEQ ID NO: 73232 - RNA, 1701 nt, Artificial Sequence
  derived and/or modified sequence opt1 from hemagglutinin__InfluenzaA__AHZ40606
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugauggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 73233 - RNA, 1701 nt, Artificial Sequence; identical to SEQ ID NO: 70891
  derived and/or modified sequence opt1 from hemagglutinin__InfluenzaA__AHZ40618

SEQ ID NO: 73234 - RNA, 1701 nt, Artificial Sequence; identical to SEQ ID NO: 70930
  derived and/or modified sequence opt1 from hemagglutinin__InfluenzaA__AHZ40626

SEQ ID NO: 73235 - RNA, 1701 nt, Artificial Sequence; identical to SEQ ID NO: 70891
  derived and/or modified sequence opt1 from hemagglutinin__InfluenzaA__AHZ40638

SEQ ID NO: 73236 - RNA, 1701 nt, Artificial Sequence; identical to SEQ ID NO: 70866
  derived and/or modified sequence opt1 from hemagglutinin__InfluenzaA__AHZ40650

SEQ ID NO: 73237 - RNA, 1701 nt, Artificial Sequence
  derived and/or modified sequence opt1 from hemagglutinin__InfluenzaA__AHZ40662
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccgcaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcggagcaaggcccacuccaacugcuaccccuacgacgugccggacuacgcgagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccugaacuucaaguaccccgcccugaacgugaccauccccaacaacgagcaguucgacaagcucuacaucuggggcguccaccaccccgggaccgacaaggaccagaucuuccuguacgcgcaggccagcgggcgcaucaccguguccacgaagcggagccagcagaccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgccugcaucacgcccaacggcuccauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggcgugccagaaggggaacauccgcugcaacaucugcaucuga

SEQ ID NO: 73238 - RNA, 1701 nt, Artificial Sequence; identical to SEQ ID NO: 70911
  derived and/or modified sequence opt1 from hemagglutinin__InfluenzaA__AHZ40674

SEQ ID NO: 73239 - RNA, 1701 nt, Artificial Sequence; identical to SEQ ID NO: 70891
  derived and/or modified sequence opt1 from hemagglutinin__InfluenzaA__AHZ40686

SEQ ID NO: 73240 - RNA, 1701 nt, Artificial Sequence; identical to SEQ ID NO: 70876
  derived and/or modified sequence opt1 from hemagglutinin__InfluenzaA__AHZ40698

SEQ ID NO: 73241 - RNA, 1701 nt, Artificial Sequence; identical to SEQ ID NO: 70876
  derived and/or modified sequence opt1 from hemagglutinin__InfluenzaA__AHZ40710

SEQ ID NO: 73242 - RNA, 1701 nt, Artificial Sequence; identical to SEQ ID NO: 71002
  derived and/or modified sequence opt1 from hemagglutinin__InfluenzaA__AHZ40722

SEQ ID NO: 73243 - RNA, 1701 nt, Artificial Sequence; identical to SEQ ID NO: 70899
  derived and/or modified sequence opt1 from hemagglutinin__InfluenzaA__AHZ40734

SEQ ID NO: 73244 - RNA, 1701 nt, Artificial Sequence; identical to SEQ ID NO: 71002
  derived and/or modified sequence opt1 from hemagglutinin__InfluenzaA__AHZ40746

SEQ ID NO: 73245 - RNA, 1701 nt, Artificial Sequence; identical to SEQ ID NO: 73195
  derived and/or modified sequence opt1 from hemagglutinin__InfluenzaA__AHZ40758

SEQ ID NO: 73246 - RNA, 1701 nt, Artificial Sequence; identical to SEQ ID NO: 63675
  derived and/or modified sequence opt1 from hemagglutinin__InfluenzaA__AHZ40782

SEQ ID NO: 73247 - RNA, 1701 nt, Artificial Sequence; identical to SEQ ID NO: 63675
  derived and/or modified sequence opt1 from hemagglutinin__InfluenzaA__AHZ40793

SEQ ID NO: 73248 - RNA, 1701 nt, Artificial Sequence; identical to SEQ ID NO: 63675
  derived and/or modified sequence opt1 from hemagglutinin__InfluenzaA__AHZ40804

SEQ ID NO: 73249 - RNA, 1701 nt, Artificial Sequence
  derived and/or modified sequence opt1 from hemagglutinin__InfluenzaA__AHZ40815
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagccggagaucgccauccgccccaagguccgggaccgcgagggccggaugaacuacuacuggacgcugguggagcccggggacaagaucaccuucgaggcgaccggcaaccucguggucccccgcuacgccuucgccauggagcggaacgccggguccggcaucaucaucagcgacaccccggugcacgacugcaacacgaccugccagacccccaagggcgccaucaacaccucccugcccuuccagaacauccaccccaucacgaucgggaagugcccgaaguacgucaagagcaccaagcugcgccucgcgaccggccugcggaacauccccuccauccagagccgcgggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgugaucgagaagaugaacacccaguucaccgccgucggcaaggaguucaaccaccuggagaagcggaucgagaaccugaacaagaagguggacgacggcuuccucgacaucuggacguacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 73250 - RNA, 1701 nt, Artificial Sequence
  derived and/or modified sequence opt1 from hemagglutinin__InfluenzaA__AHZ40826
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcaguccaucuaccagaacgccgacgccuacguguucgugggcagcucccgguacagcaagaaguucaagccggagaucgccauccgccccaagguccgggaccaggagggccgcaugaacuacuacuggacgcugguggagcccggggacaagaucaccuucgaggcgaccggcaaccugguggucccccgguacgccuucgccauggagcgcaacgccggguccggcaucaucaucagcgacaccccggugcacgacugcaacacgaccugccagacccccaagggcgccaucaacaccucccuccccuuccagaacauccaccccaucacgaucgggaagugcccgaaguacgucaagagcaccaagcugcggcuggcgaccggccuccgcaacauccccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggcuuccuggacaucuggacguacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagagcacccgcaucuaccagauccucgcgaucuacuccaccguggccagcagccugguccugguggugucccucggggccaucagcuucuggaugugcuccaacggcagccugcagugccggaucugcaucuga

SEQ ID NO: 73251 - RNA, 1701 nt, Artificial Sequence
  derived and/or modified sequence opt1 from hemagglutinin__InfluenzaA__AHZ40848
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaaggaggggaacuccuaccccaagcugagcaaguccuacaucaacgacaagggcaaggaggugcugguccucugggggauccaccaccccagcaccagcgccgagcagcagucccuguaccagaacgccgacgccuacguguucgugggcagcucccgguacagcaagaaguucaagccggagaucgccgcgcgccccaagguccggggccaggccgggcgcaugaacuacuacuggacgcugguggagcccggcgacaagaucaccuucgaggccaccgggaaccucguggucccccgguacgccuucgccauggagcgcaacgcgggcuccggcaucaucaucagcgacaccccggugcacgacugcaacacgaccugccagacccccaagggggccaucaacaccucccugcccuuccagaacauccaccccaucacgaucggcaagugcccgaaguacgucaagagcaccaagcugcggcucgccaccgggcugcgcaacauccccuccauccagagccggggccuguucggggccaucgccggcuucaucgagggcggguggaccggcaugguggacgggugguacggcuaccaccaccagaacgagcagggguccggcuacgcggccgaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggccaucuacuccaccguggccagcagccugguccucguggugucccugggcgcgaucagcuucuggaugugcuccaacggcagccugcagugccggaucugcaucuga

SEQ ID NO: 73252 - RNA, 1701 nt, Artificial Sequence
  derived and/or modified sequence opt1 from hemagglutinin__InfluenzaA__AHZ40881
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgagcagcagucccuguaccagaacgccgacgccuacguguucgugggcagcucccgguacagcaagaaguucaagccggagaucgccgcgcgccccaagguccggggccaggccgggcgcaugaacuacuacuggacgcugguggagcccggcgacaagaucaccuucgaggccaccgggaaccucguggucccccgguacgccuucgccauggagcgcaacgcgggcuccggcaucaucaucagcgacaccccggugcacgacugcaacacgaccugccagacccccaagggggccaucaacaccucccugcccuuccagaacauccaccccaucacgaucggcaagugcccgaaguacgucaagagcaccaagcugcggcucgccaccgggcugcgcaacauccccuccauccagagccggggccuguucggggccaucgccggcuucaucgagggcggguggaccggcaugguggacgggugguacggcuaccaccaccagaacgagcagggguccggcuacgcggccgaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggccaucuacuccaccguggccagcagccugguccucguggugucccugggcgcgaucagcuucuggaugugcuccaacggcagccugcagugccggaucugcaucuga

SEQ ID NO: 73253 - RNA, 1701 nt, Artificial Sequence; identical to SEQ ID NO: 73252
  derived and/or modified sequence opt1 from hemagglutinin__InfluenzaA__AHZ40892

SEQ ID NO: 73254 - RNA, 1701 nt, Artificial Sequence; identical to SEQ ID NO: 73251
  derived and/or modified sequence opt1 from hemagglutinin__InfluenzaA__AHZ40914

SEQ ID NO: 73255 - RNA, 1701 nt, Artificial Sequence; identical to SEQ ID NO: 73252
  derived and/or modified sequence opt1 from hemagglutinin__InfluenzaA__AHZ40925

SEQ ID NO: 73256 - RNA, 1701 nt, Artificial Sequence
  derived and/or modified sequence opt1 from hemagglutinin__InfluenzaA__AHZ40936
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgagcagcagucccuguaccagaacgccgacgccuacguguucgugggcagcucccgguacagcaagaaguucaagccggagaucgccgcgcgccccaagguccgggaccaggccggccgcaugaacuacuacuggacgcugguggagcccggggacaagaucaccuucgaggccaccggcaaccucguggucccccgguacgccuucgccauggagcgcaacgcgggguccggcaucaucaucagcgacaccccggugcacgacugcaacacgaccugccagacccccaagggcgccaucaacaccucccugcccuuccagaacauccaccccaucacgaucgggaagugcccgaaguacgucaagagcaccaagcugcggcucgccaccggccugcgcaacauccccuccauccagagccgggggcuguucggcgccaucgccggguucaucgagggcggcuggaccgggaugguggacggcugguacggguaccaccaccagaacgagcagggcuccggguacgcggccgaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgcgaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggccagcagccugguccucguggugucccugggggcgaucagcuucuggaugugcuccaacggcagccugcagugccggaucugcaucuga

SEQ ID NO: 73257 - RNA, 1701 nt, Artificial Sequence; identical to SEQ ID NO: 73251
  derived and/or modified sequence opt1 from hemagglutinin__InfluenzaA__AHZ40947

SEQ ID NO: 73258 - RNA, 1701 nt, Artificial Sequence; identical to SEQ ID NO: 73252
  derived and/or modified sequence opt1 from hemagglutinin__InfluenzaA__AHZ40958

SEQ ID NO: 73259 - RNA, 1701 nt, Artificial Sequence; identical to SEQ ID NO: 73256
  derived and/or modified sequence opt1 from hemagglutinin__InfluenzaA__AHZ40969

SEQ ID NO: 73260 - RNA, 1701 nt, Artificial Sequence; identical to SEQ ID NO: 73256
  derived and/or modified sequence opt1 from hemagglutinin__InfluenzaA__AHZ40980

SEQ ID NO: 73261 - RNA, 1701 nt, Artificial Sequence; identical to SEQ ID NO: 73256
  derived and/or modified sequence opt1 from hemagglutinin__InfluenzaA__AHZ40991

SEQ ID NO: 73262 - RNA, 1701 nt, Artificial Sequence; identical to SEQ ID NO: 73256
  derived and/or modified sequence opt1 from hemagglutinin__InfluenzaA__AHZ41002

SEQ ID NO: 73263 - RNA, 1701 nt, Artificial Sequence; identical to SEQ ID NO: 73256
  derived and/or modified sequence opt1 from hemagglutinin__InfluenzaA__AHZ41013

SEQ ID NO: 73264 - RNA, 1701 nt, Artificial Sequence; identical to SEQ ID NO: 73252
  derived and/or modified sequence opt1 from hemagglutinin__InfluenzaA__AHZ41024

SEQ ID NO: 73265 - RNA, 1701 nt, Artificial Sequence; identical to SEQ ID NO: 73252
  derived and/or modified sequence opt1 from hemagglutinin__InfluenzaA__AHZ41035

SEQ ID NO: 73266 - RNA, 1701 nt, Artificial Sequence; identical to SEQ ID NO: 73252
  derived and/or modified sequence opt1 from hemagglutinin__InfluenzaA__AHZ41046

SEQ ID NO: 73267 - RNA, 1701 nt, Artificial Sequence; identical to SEQ ID NO: 73252
  derived and/or modified sequence opt1 from hemagglutinin__InfluenzaA__AHZ41057

SEQ ID NO: 73268 - RNA, 1701 nt, Artificial Sequence; identical to SEQ ID NO: 73252
  derived and/or modified sequence opt1 from hemagglutinin__InfluenzaA__AHZ41068

SEQ ID NO: 73269 - RNA, 1701 nt, Artificial Sequence; identical to SEQ ID NO: 73256
  derived and/or modified sequence opt1 from hemagglutinin__InfluenzaA__AHZ41079

SEQ ID NO: 73270 - RNA, 1701 nt, Artificial Sequence; identical to SEQ ID NO: 73252
  derived and/or modified sequence opt1 from hemagglutinin__InfluenzaA__AHZ41090

SEQ ID NO: 73271 - RNA, 1701 nt, Artificial Sequence; identical to SEQ ID NO: 73256
  derived and/or modified sequence opt1 from hemagglutinin__InfluenzaA__AHZ41101

SEQ ID NO: 73272 - RNA, 1701 nt, Artificial Sequence; identical to SEQ ID NO: 73252
  derived and/or modified sequence opt1 from hemagglutinin__InfluenzaA__AHZ41112

SEQ ID NO: 73273 - RNA, 1701 nt, Artificial Sequence; identical to SEQ ID NO: 73252
  derived and/or modified sequence opt1 from hemagglutinin__InfluenzaA__AHZ41123

SEQ ID NO: 73274 - RNA, 1701 nt, Artificial Sequence; identical to SEQ ID NO: 73252
  derived and/or modified sequence opt1 from hemagglutinin__InfluenzaA__AHZ41134

SEQ ID NO: 73275 - RNA, 1701 nt, Artificial Sequence; identical to SEQ ID NO: 73252
  derived and/or modified sequence opt1 from hemagglutinin__InfluenzaA__AHZ41145

SEQ ID NO: 73276 - RNA, 1701 nt, Artificial Sequence; identical to SEQ ID NO: 73252
  derived and/or modified sequence opt1 from hemagglutinin__InfluenzaA__AHZ41156

SEQ ID NO: 73277 - RNA, 1701 nt, Artificial Sequence; identical to SEQ ID NO: 73252
  derived and/or modified sequence opt1 from hemagglutinin__InfluenzaA__AHZ41167

SEQ ID NO: 73278 - RNA, 1701 nt, Artificial Sequence; identical to SEQ ID NO: 73252
  derived and/or modified sequence opt1 from hemagglutinin__InfluenzaA__AHZ41178

SEQ ID NO: 73279 - RNA, 1701 nt, Artificial Sequence; identical to SEQ ID NO: 73252
  derived and/or modified sequence opt1 from hemagglutinin__InfluenzaA__AHZ41189

SEQ ID NO: 73280 - RNA, 1701 nt, Artificial Sequence; identical to SEQ ID NO: 73251
  derived and/or modified sequence opt1 from hemagglutinin__InfluenzaA__AHZ41246

SEQ ID NO: 73281 - RNA, 1701 nt, Artificial Sequence; identical to SEQ ID NO: 73256
  derived and/or modified sequence opt1 from hemagglutinin__InfluenzaA__AHZ41263

SEQ ID NO: 73282 - RNA, 1701 nt, Artificial Sequence; identical to SEQ ID NO: 73252
  derived and/or modified sequence opt1 from hemagglutinin__InfluenzaA__AHZ41281

SEQ ID NO: 73283 - RNA, 1701 nt, Artificial Sequence; identical to SEQ ID NO: 73252
  derived and/or modified sequence opt1 from hemagglutinin__InfluenzaA__AHZ41292

SEQ ID NO: 73284 - RNA, 1701 nt, Artificial Sequence; identical to SEQ ID NO: 73251
  derived and/or modified sequence opt1 from hemagglutinin__InfluenzaA__AHZ41303

SEQ ID NO: 73285 - RNA, 1701 nt, Artificial Sequence; identical to SEQ ID NO: 73251
  derived and/or modified sequence opt1 from hemagglutinin__InfluenzaA__AHZ41314

SEQ ID NO: 73286 - RNA, 1701 nt, Artificial Sequence; identical to SEQ ID NO: 73251
  derived and/or modified sequence opt1 from hemagglutinin__InfluenzaA__AHZ41325

SEQ ID NO: 73287 - RNA, 1701 nt, Artificial Sequence; identical to SEQ ID NO: 73251
  derived and/or modified sequence opt1 from hemagglutinin__InfluenzaA__AHZ41336

SEQ ID NO: 73288 - RNA, 1701 nt, Artificial Sequence; identical to SEQ ID NO: 73251
  derived and/or modified sequence opt1 from hemagglutinin__InfluenzaA__AHZ41347

SEQ ID NO: 73289 - RNA, 1701 nt, Artificial Sequence; identical to SEQ ID NO: 73252
  derived and/or modified sequence opt1 from hemagglutinin__InfluenzaA__AHZ41358

SEQ ID NO: 73290 - RNA, 1701 nt, Artificial Sequence; identical to SEQ ID NO: 73252
  derived and/or modified sequence opt1 from hemagglutinin__InfluenzaA__AHZ41366

SEQ ID NO: 73291 - RNA, 1701 nt, Artificial Sequence; identical to SEQ ID NO: 73256
  derived and/or modified sequence opt1 from hemagglutinin__InfluenzaA__AHZ41377

SEQ ID NO: 73292 - RNA, 1701 nt, Artificial Sequence; identical to SEQ ID NO: 73252
  derived and/or modified sequence opt1 from hemagglutinin__InfluenzaA__AHZ41388

SEQ ID NO: 73293 - RNA, 1701 nt, Artificial Sequence; identical to SEQ ID NO: 73256
  derived and/or modified sequence opt1 from hemagglutinin__InfluenzaA__AHZ41410

SEQ ID NO: 73294 - RNA, 1701 nt, Artificial Sequence; identical to SEQ ID NO: 73252
  derived and/or modified sequence opt1 from hemagglutinin__InfluenzaA__AHZ41432

SEQ ID NO: 73295 - RNA, 1701 nt, Artificial Sequence
  derived and/or modified sequence opt1 from hemagglutinin__InfluenzaA__AHZ41441
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaaggaggggaacuccuaccccaagcugagcaaguccuacaucaacgacaagggcaaggaggugcugguccucugggggauccaccaccccagcaccagcgccgagcagcagucccuguaccagaacgccgacgccuacguguucgugggcagcucccgguacagcaagaaguucaagccggagaucgccgcgcgccccaagguccgggaccaggccggccgcaugaacuacuacuggacgcugguggagcccggggacaagaucaccuucgaggccaccggcaaccucguggucccccgguacgccuucgccauggagcgcaacgcgggguccggcaucaucaucagcgacaccccggugcacgacugcaacacgaccugccagacccccaagggcgccaucaacaccucccugcccuuccagaacauccaccccaucacgaucgggaagugcccgaaguacgucaagagcaccaagcugcggcucgccaccggccugcgcaacauccccuccauccagagccgggggcuguucggcgccaucgccggguucaucgagggcggcuggaccgggaugguggacggcugguacggguaccaccaccagaacgagcagggcuccggguacgcggccgaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgcgaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggccagcagccugguccucguggugucccugggggcgaucagcuucuggaugugcuccaacggcagccugcagugccggaucugcaucuga

SEQ ID NO: 73296 - RNA, 1701 nt, Artificial Sequence; identical to SEQ ID NO: 73251
  derived and/or modified sequence opt1 from hemagglutinin__InfluenzaA__AHZ41452

SEQ ID NO: 73297 - RNA, 1701 nt, Artificial Sequence
  derived and/or modified sequence opt1 from hemagglutinin__InfluenzaA__AHZ41463
augaaggccauccuggugguccuccuguacaccuucgccaccgcgaacgccgacacgcugugcaucggcuaccacgccaacaacagcaccgacaccguguacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgagcagcagucccuguaccagaacgccgacgccuacguguucgugggcagcucccgguacagcaagaaguucaagccggagaucgccgcgcgccccaagguccggggccaggccgggcgcaugaacuacuacuggacgcugguggagcccggcgacaagaucaccuucgaggccaccgggaaccucguggucccccgguacgccuucgccauggagcgcaacgcgggcuccggcaucaucaucagcgacaccccggugcacgacugcaacacgaccugccagacccccaagggggccaucaacaccucccugcccuuccagaacauccaccccaucacgaucggcaagugcccgaaguacgucaagagcaccaagcugcggcucgccaccgggcugcgcaacauccccuccauccagagccggggccuguucggggccaucgccggcuucaucgagggcggguggaccggcaugguggacgggugguacggcuaccaccaccagaacgagcagggguccggcuacgcggccgaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggccaucuacuccaccguggccagcagccugguccucguggugucccugggcgcgaucagcuucuggaugugcuccaacggcagccugcagugccggaucugcaucuga

SEQ ID NO: 73298 - RNA, 1701 nt, Artificial Sequence; identical to SEQ ID NO: 73251
  derived and/or modified sequence opt1 from hemagglutinin__InfluenzaA__AHZ41473

SEQ ID NO: 73299 - RNA, 1701 nt, Artificial Sequence; identical to SEQ ID NO: 73251
  derived and/or modified sequence opt1 from hemagglutinin__InfluenzaA__AHZ41484

SEQ ID NO: 73300 - RNA, 1701 nt, Artificial Sequence; identical to SEQ ID NO: 73256
  derived and/or modified sequence opt1 from hemagglutinin__InfluenzaA__AHZ41495

SEQ ID NO: 73301 - RNA, 1701 nt, Artificial Sequence; identical to SEQ ID NO: 73251
  derived and/or modified sequence opt1 from hemagglutinin__InfluenzaA__AHZ41506

SEQ ID NO: 73302 - RNA, 1701 nt, Artificial Sequence
  derived and/or modified sequence opt1 from hemagglutinin__InfluenzaA__AHZ41517
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcgaguccuacaucaacgacaagggcaaggaggugcugguccucugggggauccaccaccccagcaccagcgccgagcagcagucccuguaccagaacgccgacgccuacguguucgugggcagcucccgguacagcaagaaguucaagccggagaucgccgcgcgccccaagguccggggccaggccgggcgcaugaacuacuacuggacgcugguggagcccggcgacaagaucaccuucgaggccaccgggaaccucguggucccccgguacgccuucgccauggagcgcaacgcgggcuccggcaucaucaucagcgacaccccggugcacgacugcaacacgaccugccagacccccaagggggccaucaacaccucccugcccuuccagaacauccaccccaucacgaucggcaagugcccgaaguacgucaagagcaccaagcugcggcucgccaccgggcugcgcaacauccccuccauccagagccggggccuguucggggccaucgccggcuucaucgagggcggguggaccggcaugguggacgggugguacggcuaccaccaccagaacgagcagggguccggcuacgcggccgaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggccaucuacuccaccguggccagcagccugguccucguggugucccugggcgcgaucagcuucuggaugugcuccaacggcagccugcagugccggaucugcaucuga

SEQ ID NO: 73303 - RNA, 1701 nt, Artificial Sequence
  derived and/or modified sequence opt1 from hemagglutinin__InfluenzaA__AHZ41528
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcgaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagccggagaucgccgcgcgccccaagguccggggccaggccgggcgcaugaacuacuacuggacgcugguggagcccggcgacaagaucaccuucgaggccaccgggaaccucguggucccccgguacgccuucgccauggagcgcaacgcgggcuccggcaucaucaucagcgacaccccggugcacgacugcaacacgaccugccagacccccaagggggccaucaacaccucccugcccuuccagaacauccaccccaucacgaucggcaagugcccgaaguacgucaagagcaccaagcugcggcucgccaccgggcugcgcaacauccccuccauccagagccggggccuguucggggccaucgccggcuucaucgagggcggguggaccggcaugguggacgggugguacggcuaccaccaccagaacgagcagggguccggcuacgcggccgaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggccaucuacuccaccguggccagcagccugguccucguggugucccugggcgcgaucagcuucuggaugugcuccaacggcagccugcagugccggaucugcaucuga

SEQ ID NO: 73304 - RNA, 1701 nt, Artificial Sequence; identical to SEQ ID NO: 73256
  derived and/or modified sequence opt1 from hemagglutinin__InfluenzaA__AHZ41539

SEQ ID NO: 73305 - RNA, 1701 nt, Artificial Sequence; identical to SEQ ID NO: 73251
  derived and/or modified sequence opt1 from hemagglutinin__InfluenzaA__AHZ41550

SEQ ID NO: 73306 - RNA, 1701 nt, Artificial Sequence; identical to SEQ ID NO: 73252
  derived and/or modified sequence opt1 from hemagglutinin__InfluenzaA__AHZ41561

SEQ ID NO: 73307 - RNA, 1701 nt, Artificial Sequence
  derived and/or modified sequence opt1 from hemagglutinin__InfluenzaA__AHZ41572
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgagcagcagucccuguaccagaacgccgacgccuacguguucgugggcagcucccgguacagcaagaaguucaagccggagaucgccgcgcgccccaagguccggggccaggccgggcgcaugaacuacuacuggacgcugguggagcccggcgacgagaucaccuucgaggccaccgggaaccucguggucccccgguacgccuucgccauggagcgcaacgcgggcuccggcaucaucaucagcgacaccccggugcacgacugcaacacgaccugccagacccccaagggggccaucaacaccucccugcccuuccagaacauccaccccaucacgaucggcaagugcccgaaguacgucaagagcaccaagcugcggcucgccaccgggcugcgcaacauccccuccauccagagccggggccuguucggggccaucgccggcuucaucgagggcggguggaccggcaugguggacgggugguacggcuaccaccaccagaacgagcagggguccggcuacgcggccgaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggccaucuacuccaccguggccagcagccugguccucguggugucccugggcgcgaucagcuucuggaugugcuccaacggcagccugcagugccggaucugcaucuga

SEQ ID NO: 73308 - RNA, 1701 nt, Artificial Sequence; identical to SEQ ID NO: 73256
  derived and/or modified sequence opt1 from hemagglutinin__InfluenzaA__AHZ41583

SEQ ID NO: 73309 - RNA, 1701 nt, Artificial Sequence; identical to SEQ ID NO: 73251
  derived and/or modified sequence opt1 from hemagglutinin__InfluenzaA__AHZ41594

SEQ ID NO: 73310 - RNA, 1701 nt, Artificial Sequence
  derived and/or modified sequence opt1 from hemagglutinin__InfluenzaA__AHZ41605
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaacaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgagcagcagucccuguaccagaacgccgacgccuacguguucgugggcagcucccgguacagcaagaaguucaagccggagaucgccgcgcgccccaaggucaugggccaggccgggcggaugaacuacuacuggacgcugguggagcccggcgacaagaucaccuucgaggccaccgggaaccucguggucccccgcuacgccuucgccauggagcggaacgcgggcuccggcaucaucaucagcgacaccccggugcacgacugcaacacgaccugccagacccccaagggggccaucaacaccucccugcccuuccagaacauccaccccaucacgaucggcaagugcccgaaguacgucaagagcaccaagcugcgccucgccaccgggcugcggaacauccccuccauccagagccgcggccuguucggggccaucgccggcuucaucgagggcggguggaccggcaugguggacgggugguacggcuaccaccaccagaacgagcagggguccggcuacgcggccgaccucaagagcacgcagaacgccaucgacgagaucaccaacaaggugaacuccgugaucgagaagaugaacacccaguucaccgccgucggcaaggaguucaaccaccuggagaagcggaucgagaaccugaacaagaagguggacgacggguuccucgacaucuggacguacaacgccgagcugcugguccuccuggagaacgagcgcacccuggacuaccacgacagcaacgugaagaaccucuacgagaaggugcggucccagcugaagaacaacgcgaaggagaucggcaacgggugcuucgaguucuaccacaagugcgacaacacgugcauggagagcgucaagaacggcaccuacgacuaccccaaguacuccgaggaggccaagcugaaccgcgaggagaucgacggggugaagcucgagagcacccggaucuaccagauccuggccaucuacuccaccguggccagcagccugguccucguggugucccugggcgcgaucagcuucuggaugugcuccaacggcagccugcagugccgcaucugcaucuga

SEQ ID NO: 73311 - RNA, 1701 nt, Artificial Sequence; identical to SEQ ID NO: 73251
  derived and/or modified sequence opt1 from hemagglutinin__InfluenzaA__AHZ41616

SEQ ID NO: 73312 - RNA, 1701 nt, Artificial Sequence; identical to SEQ ID NO: 73256
  derived and/or modified sequence opt1 from hemagglutinin__InfluenzaA__AHZ41627

SEQ ID NO: 73313 - RNA, 1701 nt, Artificial Sequence; identical to SEQ ID NO: 73256
  derived and/or modified sequence opt1 from hemagglutinin__InfluenzaA__AHZ41638

SEQ ID NO: 73314 - RNA, 1701 nt, Artificial Sequence; identical to SEQ ID NO: 73252
  derived and/or modified sequence opt1 from hemagglutinin__InfluenzaA__AHZ41649

SEQ ID NO: 73315 - RNA, 1701 nt, Artificial Sequence; identical to SEQ ID NO: 73252
  derived and/or modified sequence opt1 from hemagglutinin__InfluenzaA__AHZ41660

SEQ ID NO: 73316 - RNA, 1701 nt, Artificial Sequence; identical to SEQ ID NO: 73256
  derived and/or modified sequence opt1 from hemagglutinin__InfluenzaA__AHZ41671

SEQ ID NO: 73317 - RNA, 1701 nt, Artificial Sequence; identical to SEQ ID NO: 73256
  derived and/or modified sequence opt1 from hemagglutinin__InfluenzaA__AHZ41682

SEQ ID NO: 73318 - RNA, 1701 nt, Artificial Sequence; identical to SEQ ID NO: 73256
  derived and/or modified sequence opt1 from hemagglutinin__InfluenzaA__AHZ41693

SEQ ID NO: 73319 - RNA, 1701 nt, Artificial Sequence; identical to SEQ ID NO: 73256
  derived and/or modified sequence opt1 from hemagglutinin__InfluenzaA__AHZ41704

SEQ ID NO: 73320 - RNA, 1701 nt, Artificial Sequence; identical to SEQ ID NO: 73256
  derived and/or modified sequence opt1 from hemagglutinin__InfluenzaA__AHZ41715

SEQ ID NO: 73321 - RNA, 1701 nt, Artificial Sequence; identical to SEQ ID NO: 73256
  derived and/or modified sequence opt1 from hemagglutinin__InfluenzaA__AHZ41726

SEQ ID NO: 73322 - RNA, 1701 nt, Artificial Sequence; identical to SEQ ID NO: 73256
  derived and/or modified sequence opt1 from hemagglutinin__InfluenzaA__AHZ41737

SEQ ID NO: 73323 - RNA, 1701 nt, Artificial Sequence; identical to SEQ ID NO: 73256
  derived and/or modified sequence opt1 from hemagglutinin__InfluenzaA__AHZ41748

SEQ ID NO: 73324 - RNA, 1701 nt, Artificial Sequence; identical to SEQ ID NO: 73256
  derived and/or modified sequence opt1 from hemagglutinin__InfluenzaA__AHZ41759

SEQ ID NO: 73325 - RNA, 1701 nt, Artificial Sequence; identical to SEQ ID NO: 71083
  derived and/or modified sequence opt1 from hemagglutinin__InfluenzaA__AHZ42561

SEQ ID NO: 73326 - RNA, 1701 nt, Artificial Sequence
  derived and/or modified sequence opt1 from hemagglutinin__InfluenzaA__AHZ42572
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagauggacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 73327 - RNA, 1701 nt, Artificial Sequence; identical to SEQ ID NO: 72794
  derived and/or modified sequence opt1 from hemagglutinin__InfluenzaA__AHZ42584

SEQ ID NO: 73328 - RNA, 1701 nt, Artificial Sequence; identical to SEQ ID NO: 70891
  derived and/or modified sequence opt1 from hemagglutinin__InfluenzaA__AHZ42596

SEQ ID NO: 73329 - RNA, 1701 nt, Artificial Sequence; identical to SEQ ID NO: 71068
  derived and/or modified sequence opt1 from hemagglutinin__InfluenzaA__AHZ42608

SEQ ID NO: 73330 - RNA, 1701 nt, Artificial Sequence; identical to SEQ ID NO: 70891
  derived and/or modified sequence opt1 from hemagglutinin__InfluenzaA__AHZ42619

SEQ ID NO: 73331 - RNA, 1701 nt, Artificial Sequence
  derived and/or modified sequence opt1 from hemagglutinin__InfluenzaA__AHZ42631
augaagaccaucaucgcccugagcuacauccucugccugguguucgcccagaagcugcccggcaacuacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 73332 - RNA, 1701 nt, Artificial Sequence
  derived and/or modified sequence opt1 from hemagglutinin__InfluenzaA__AHZ42643
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccggcagcgacaacggcacgugcuaccccggggacuucaucgacuacgaggagcugcgggagcagcucuccagcguguccagcuucgagcgcuucgagaucuuccccaaggccuccagcuggcccaaccacgacuccaacaagggcgucaccgccgccugcccgcacgcgggggccaagggcuucuacaagaaccugaucuggcuggugaagaaggggaacagcuaccccaagcucuccaucagcuacaucaacgacaagggcaaggaggugcugguccuguggggcauccaccaccccuccaccaccgccgaccagcagagccucuaccagaacgccgacacguacguguucguggggaccagccgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucgccauggagcgcaacgccggcagcgggaucaucaucuccgacacccccgugcacgacugcaacacgaccugccagaccccgaagggcgccaucaacaccagccuccccuuccagaacauccaccccaucaccaucgggaagugccccaaguacgugaaguccaccaagcugcggcuggcgacgggccuccgcaacgucccgagcauccagucccgggggcuguucggcgccaucgccggcuucaucgagggcggguggaccgggaugguggacggcugguacggguaccaccaccagaacgagcagggcagcggcuacgccgccgaccugaaguccacccagaacgcgaucgacaagaucaccaacaaggugaacagcgucaucgagaagaugaacacgcaguucaccgccguggggaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgcgaucuacuccaccgccgccagcucccugguccugguggugagccucggcgccaucuccuucuggaugugcagcaacgggagccugcagugccggaucugcaucuga

SEQ ID NO: 73333 - RNA, 1701 nt, Artificial Sequence; identical to SEQ ID NO: 70891
  derived and/or modified sequence opt1 from hemagglutinin__InfluenzaA__AHZ42654

SEQ ID NO: 73334 - RNA, 1701 nt, Artificial Sequence; identical to SEQ ID NO: 70866
  derived and/or modified sequence opt1 from hemagglutinin__InfluenzaA__AHZ42666

SEQ ID NO: 73335 - RNA, 1701 nt, Artificial Sequence; identical to SEQ ID NO: 70866
  derived and/or modified sequence opt1 from hemagglutinin__InfluenzaA__AHZ42678

SEQ ID NO: 73336 - RNA, 1701 nt, Artificial Sequence
  derived and/or modified sequence opt1 from hemagglutinin__InfluenzaA__AHZ42690
augaaggccauccuggugguccuccuguacaccuacgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacgaccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucacguucgaggccaccggcaaccucguggugccccgguacgcguucgccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 73337 - RNA, 1701 nt, Artificial Sequence; identical to SEQ ID NO: 70891
  derived and/or modified sequence opt1 from hemagglutinin__InfluenzaA__AHZ42701

SEQ ID NO: 73338 - RNA, 1701 nt, Artificial Sequence; identical to SEQ ID NO: 70866
  derived and/or modified sequence opt1 from hemagglutinin__InfluenzaA__AHZ42713

SEQ ID NO: 73339 - RNA, 1701 nt, Artificial Sequence
  derived and/or modified sequence opt1 from hemagglutinin__InfluenzaA__AHZ42725
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccggaacgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73340 - RNA, 1701 nt, Artificial Sequence
  derived and/or modified sequence opt1 from hemagglutinin__InfluenzaA__AHZ42737
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgagagcgggaucaucaucuccgacacccccguccacgacugcaacacgaccugccagaccccggagggcgccaucaacaccagccugcccuuccagaacauccaccccaucaccaucggcaagugccccaaguacgugaaguccaccaagcugcggcucgcgacggggcugcgcaacgugccgagcauccagucccggggccuguucggggccaucgccggcuucaucgagggcggguggaccggcauggucgacgggugguacggcuaccaccaccagaacgagcaggggagcggcuacgccgccgaccucaaguccacccagaacgcgaucgacaagaucaccaacaaggugaacagcgugaucgagaagaugaacacgcaguucaccgccgucgggaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggagaagaucgacggggugaagcucgagagcacccgcaucuaccagauccuggcgaucuacuccaccguggccagcucccugguccucguggugagccugggcgccaucagcuucuggaugugcuccaacgggagccugcagugccggaucugcaucuga

SEQ ID NO: 73341 - RNA, 1701 nt, Artificial Sequence; identical to SEQ ID NO: 70891
  derived and/or modified sequence opt1 from hemagglutinin__InfluenzaA__AHZ42748

SEQ ID NO: 73342 - RNA, 1701 nt, Artificial Sequence; identical to SEQ ID NO: 70911
  derived and/or modified sequence opt1 from hemagglutinin__InfluenzaA__AHZ42760

SEQ ID NO: 73343 - RNA, 1701 nt, Artificial Sequence
  derived and/or modified sequence opt1 from hemagglutinin__InfluenzaA__AHZ42772
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccgcaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcggagcaaggcccacuccaacugcuaccccuacgacgugccggacuacgcgagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggagccagcagaccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgccugcaucacgcccaacggcuccauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaaggagguggagcugaaguccggguacaaggacuggauccuguggaucuccuucgccaucagcugcuuccuccugugcgucgcccugcucggcuucaucaugugggcgugccagaagggcaacauccgcugcaacaucugcaucuga

SEQ ID NO: 73344 - RNA, 1701 nt, Artificial Sequence; identical to SEQ ID NO: 70891
  derived and/or modified sequence opt1 from hemagglutinin__InfluenzaA__AHZ42784

SEQ ID NO: 73345 - RNA, 1701 nt, Artificial Sequence; identical to SEQ ID NO: 70866
  derived and/or modified sequence opt1 from hemagglutinin__InfluenzaA__AHZ42796

SEQ ID NO: 73346 - RNA, 1701 nt, Artificial Sequence; identical to SEQ ID NO: 70866
  derived and/or modified sequence opt1 from hemagglutinin__InfluenzaA__AHZ42808

SEQ ID NO: 73347 - RNA, 1701 nt, Artificial Sequence; identical to SEQ ID NO: 73340
  derived and/or modified sequence opt1 from hemagglutinin__InfluenzaA__AHZ42820

SEQ ID NO: 73348 - RNA, 1701 nt, Artificial Sequence; identical to SEQ ID NO: 71475
  derived and/or modified sequence opt1 from hemagglutinin__InfluenzaA__AHZ42831

SEQ ID NO: 73349 - RNA, 1701 nt, Artificial Sequence
  derived and/or modified sequence opt1 from hemagglutinin__InfluenzaA__AHZ42843
augaagaccaucaucgcccugagcuacauccucugccugguguucgcccagaagcugcccggcaacgacaacuccaccgcgacgcucugccuggggcaccacgccgucccgaacggcaccauggugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 73350 - RNA, 1701 nt, Artificial Sequence
  derived and/or modified sequence opt1 from hemagglutinin__InfluenzaA__AHZ42855
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacaugacgaugcccaacaacgagcaguucgacaagcucuacaucuggggcgugcaccaccccgggaccgacaaggaccagaucuuccuguacgcgcagagcuccgggcgcaucaccgucagcaccaagcggagccagcaggccgugaucccgaacaucggcucccgcccccggauccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgucaaccggaucaccuacggggccugcccccgcuacgugaagcaguccacgcugaagcucgcgaccggcaugcggaacgugcccgagaagcagacccgcgggaucuucggcgccaucgccggguucaucgagaacggcugggagggcauggucgacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 73351 - RNA, 1701 nt, Artificial Sequence
  derived and/or modified sequence opt1 from hemagglutinin__InfluenzaA__AHZ42867
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacugggccggggugacgcagaacggcaccagcuccgccugcauccgcgggagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggagccagcaggccgugaucccgaacaucggcucccgcccccggauccgcaacauccccagccggaucuccaucuacuggaccaucgucaagcccggggacauccugcucaucaacagcacgggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacguguaccgcgacgaggcccucaacaaccgguuccagaucaagggcgucgagcucaagagcgaguacaaggacuggauccuguggaucuccuucgccaucagcugcuuccugcugugcguggcccugcucggcuucaucaugugggcgugccagaaggggaacauccgcugcaacaucugcaucuga

SEQ ID NO: 73352 - RNA, 1701 nt, Artificial Sequence; identical to SEQ ID NO: 70866
  derived and/or modified sequence opt1 from hemagglutinin__InfluenzaA__AHZ42879

SEQ ID NO: 73353 - RNA, 1701 nt, Artificial Sequence
  derived and/or modified sequence opt1 from hemagglutinin__InfluenzaA__AHZ42891
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcuccugcuaccccuacgacgugccggacuacgcgagccugcgcucccucgucgccagcuccggcacccuggaguucaacaacgagagcuucaacugggccggggugacgcagaacggcaccuccagcgccugcauccggcgcuccaacagcuccuucuucagccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcgggcgcaucaccgugagcaccaagcggucccagcaggccgugaucccgaacaucggcagccgcccccggauccgcaacauccccucccggaucagcaucuacuggaccaucgucaagcccggcgacauccugcucaucaacuccacggggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggcgugcccccgcuacgugaagcagagcacccugaagcucgccacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgcggaccucaagagcacccaggccgccaucgaccagaucaacgggaagcugaaccggcugaucggcaagaccaacgagaaguuccaccagaucgagaaggaguucuccgagguggagggccgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccggaacggcacguacgaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggcgugccagaaggggaacauccgcugcaacaucugcaucuga

SEQ ID NO: 73354 - RNA, 1701 nt, Artificial Sequence
  derived and/or modified sequence opt1 from hemagglutinin__InfluenzaA__AHZ42903
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcaacuccagcuucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 73355 - RNA, 1701 nt, Artificial Sequence; identical to SEQ ID NO: 70843
  derived and/or modified sequence opt1 from hemagglutinin__InfluenzaA__AHZ42915

SEQ ID NO: 73356 - RNA, 1683 nt, Artificial Sequence; identical to SEQ ID NO: 70996
  derived and/or modified sequence opt1 from hemagglutinin__InfluenzaA__AHZ59747

SEQ ID NO: 73357 - RNA, 1683 nt, Artificial Sequence
  derived and/or modified sequence opt1 from hemagglutinin__InfluenzaA__AHZ59759
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucaccuucagcuucaacggcgcguucaucgcccccgaccgcgccuccuuccuccggggcaagagcauggggauccaguccggcguccagguggacgccaacugcgagggggacugcuaccacagcggcgggacgaucaucuccaaccugcccuuccagaacaucgacagccgcgccgugggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaagucccgcgaggaggccaugcagaaccggauccagaucgaccccgucaagcucagcuccggguacaaggacgugauccugugguucagcuucggcgccuccugcuucauccugcucgcgaucgugauggggcuggucuucaucugcgugaagaacggcaacaugcgcugcaccaucugcaucuga

SEQ ID NO: 73358 - RNA, 1683 nt, Artificial Sequence
  derived and/or modified sequence opt1 from hemagglutinin__InfluenzaA__AHZ59771
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccagagcgggcggaucgacuuccacuggcucaugcugaaccccaacgacaccgucaccuucagcuucaacggcgcguucaucgcccccgaccgcgccuccuuccugcggggcaagagcauggggauccaguccggcguccagguggacgccaacugcgagggggacugcuaccacagcggcgggacgaucaucuccaaccuccccuuccagaacaucgacagccgcgccgugggcaagugcccgcgguacgugaagcagcgcucccugcugcucgcgaccgggaugaagaacgugcccgagauccccaagggccggggccuguucggggccaucgccggcuucaucgagaacgggugggagggccugaucgacgggugguacggcuuccgccaccagaacgcccagggcgaggggaccgccgcggacuacaagagcacccaguccgccaucgaccagaucacgggcaagcucaaccggcugaucgagaagaccaaccagcaguucgagcugaucgacaacgaguucaacgaggucgagaagcagaucgggaacgugaucaacuggacccgcgacagcaucaccgaggugugguccuacaacgccgagcuccuggucgccauggagaaccagcacacgaucgaccuggccgacagcgagauggacaagcucuacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcuguccagcggguacaaggacgugauccucugguucuccuucggcgccagcugcuucauccugcuggcgaucgugauggggcucgucuucaucugcgugaagaacggcaacaugcgcugcaccaucugcaucuga

SEQ ID NO: 73359 - RNA, 1683 nt, Artificial Sequence
  derived and/or modified sequence opt1 from hemagglutinin__InfluenzaA__AHZ59795
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcaccacgagcgccugccggcgcuccgggagcuccuucuacgccgagaugaaguggcugcugagcaacaccgacaacgccgcguucccgcagaugaccaaguccuacaagaacacccgcaagagccccgcccucaucgucuggggcauccaccacuccgugagcacggccgagcagaccaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucacguucagcuucaacggcgccuucaucgcgcccgaccgcgccuccuuccuccggggcaagagcauggggauccaguccggcguccagguggacgccaacugcgagggggacugcuaccacagcggcgggaccaucaucuccaaccugcccuuccagaacaucgacagccgcgccgugggcaagugcccgcgguacgugaagcagcgcucccugcuccuggccaccgggaugaagaacgugcccgagauccccaagggccggggccuguucggggcgaucgccggcuucaucgagaacgggugggagggccucaucgacgggugguacggcuuccgccaccagaacgcccagggcgaggggaccgccgccgacuacaagagcacgcaguccgcgaucgaccagaucaccggcaagcugaaccggcugaucgagaagaccaaccagcaguucgagcucaucgacaacgaguucaacgaggucgagaagcagaucgggaacgugaucaacuggacccgcgacagcaucacggaggugugguccuacaacgccgagcugcuggucgccauggagaaccagcacaccaucgaccucgccgacagcgagauggacaagcuguacgagcgcgugaagcggcagcugcgcgagaacgccgaggaggacggcaccggcugcuucgagaucuuccacaagugcgacgacgacugcauggcguccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgccaucgugauggggcuggucuucaucugcgugaagaacggcaacaugcgcugcacgaucugcaucuga

SEQ ID NO: 73360 - RNA, 1683 nt, Artificial Sequence; identical to SEQ ID NO: 73359
  derived and/or modified sequence opt1 from hemagglutinin__InfluenzaA__AHZ59807

SEQ ID NO: 73361 - RNA, 1683 nt, Artificial Sequence; identical to SEQ ID NO: 73359
  derived and/or modified sequence opt1 from hemagglutinin__InfluenzaA__AHZ59819

SEQ ID NO: 73362 - RNA, 1683 nt, Artificial Sequence; identical to SEQ ID NO: 70996
  derived and/or modified sequence opt1 from hemagglutinin__InfluenzaA__AHZ59831

SEQ ID NO: 73363 - RNA, 1683 nt, Artificial Sequence; identical to SEQ ID NO: 70996
  derived and/or modified sequence opt1 from hemagglutinin__InfluenzaA__AHZ59843

SEQ ID NO: 73364 - RNA, 1683 nt, Artificial Sequence; identical to SEQ ID NO: 70996
  derived and/or modified sequence opt1 from hemagglutinin__InfluenzaA__AHZ59855

SEQ ID NO: 73365 - RNA, 1683 nt, Artificial Sequence; identical to SEQ ID NO: 73358
  derived and/or modified sequence opt1 from hemagglutinin__InfluenzaA__AHZ59867

SEQ ID NO: 73366 - RNA, 1683 nt, Artificial Sequence; identical to SEQ ID NO: 70996
  derived and/or modified sequence opt1 from hemagglutinin__InfluenzaA__AHZ59879

SEQ ID NO: 73367 - RNA, 1683 nt, Artificial Sequence; identical to SEQ ID NO: 73358
  derived and/or modified sequence opt1 from hemagglutinin__InfluenzaA__AHZ59915

SEQ ID NO: 73368 - RNA, 1683 nt, Artificial Sequence; identical to SEQ ID NO: 70996
  derived and/or modified sequence opt1 from hemagglutinin__InfluenzaA__AHZ59927

SEQ ID NO: 73369 - RNA, 1683 nt, Artificial Sequence; identical to SEQ ID NO: 73358
  derived and/or modified sequence opt1 from hemagglutinin__InfluenzaA__AHZ59939

SEQ ID NO: 73370 - RNA, 1683 nt, Artificial Sequence; identical to SEQ ID NO: 70996
  derived and/or modified sequence opt1 from hemagglutinin__InfluenzaA__AHZ59951

SEQ ID NO: 73371 - RNA, 1683 nt, Artificial Sequence; identical to SEQ ID NO: 70996
  derived and/or modified sequence opt1 from hemagglutinin__InfluenzaA__AHZ59963

SEQ ID NO: 73372 - RNA, 1683 nt, Artificial Sequence; identical to SEQ ID NO: 70996
  derived and/or modified sequence opt1 from hemagglutinin__InfluenzaA__AHZ59988

SEQ ID NO: 73373 - RNA, 1683 nt, Artificial Sequence; identical to SEQ ID NO: 70996
  derived and/or modified sequence opt1 from hemagglutinin__InfluenzaA__AHZ60000

SEQ ID NO: 73374 - RNA, 1683 nt, Artificial Sequence; identical to SEQ ID NO: 70996
  derived and/or modified sequence opt1 from hemagglutinin__InfluenzaA__AHZ60012

SEQ ID NO: 73375 - RNA, 1683 nt, Artificial Sequence; identical to SEQ ID NO: 70996
  derived and/or modified sequence opt1 from hemagglutinin__InfluenzaA__AHZ60024

SEQ ID NO: 73376 - RNA, 1683 nt, Artificial Sequence; identical to SEQ ID NO: 73359
  derived and/or modified sequence opt1 from hemagglutinin__InfluenzaA__AHZ60036

SEQ ID NO: 73377 - RNA, 1683 nt, Artificial Sequence; identical to SEQ ID NO: 73359
  derived and/or modified sequence opt1 from hemagglutinin__InfluenzaA__AHZ60048

SEQ ID NO: 73378 - RNA, 1683 nt, Artificial Sequence; identical to SEQ ID NO: 73359
  derived and/or modified sequence opt1 from hemagglutinin__InfluenzaA__AHZ60060

SEQ ID NO: 73379 - RNA, 1683 nt, Artificial Sequence; identical to SEQ ID NO: 73359
  derived and/or modified sequence opt1 from hemagglutinin__InfluenzaA__AHZ60072

SEQ ID NO: 73380 - RNA, 1683 nt, Artificial Sequence; identical to SEQ ID NO: 73359
  derived and/or modified sequence opt1 from hemagglutinin__InfluenzaA__AHZ60084

SEQ ID NO: 73381 - RNA, 1683 nt, Artificial Sequence
  derived and/or modified sequence opt1 from hemagglutinin__InfluenzaA__AHZ60096
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacgacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucaccuucagcuucaacggcgcguucaucgcccccgaccgcgccuccuuccuccggggcaagagcauggggauccaguccggcguccagguggacgccaacugcgagggggacugcuaccacagcggcgggacgaucaucuccaaccugcccuuccagaacaucgacagccgcgccgugggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgcgaucgugauggggcuggucuucaucugcgugaagaacggcaacaugcgcugcaccaucugcaucuga

SEQ ID NO: 73382 - RNA, 1701 nt, Artificial Sequence
  derived and/or modified sequence opt1 from hemagglutinin__InfluenzaA__AIC64889
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggagaacagcuaccccaagcucuccaagagcuacaucaacgacaaggggaaggaggugcugguccuguggggcauccaccaccccagcaccuccgccgaccagcagagccucuaccagaacgccgacgccuacguguucgugggguccagccgguacuccaagaaguucaagcccgagaucgccauccgcccgaagguccggggccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 73383 - RNA, 1701 nt, Artificial Sequence; identical to SEQ ID NO: 71048
  derived and/or modified sequence opt1 from hemagglutinin__InfluenzaA__AIC73738

SEQ ID NO: 73384 - RNA, 1701 nt, Artificial Sequence
  derived and/or modified sequence opt1 from hemagglutinin__InfluenzaA__AIC73739
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgccacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73385 - RNA, 1701 nt, Artificial Sequence
  derived and/or modified sequence opt1 from hemagglutinin__InfluenzaA__AIC73740
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccacccgcccacgaccgcggaccagcagagccuguaccagaacgccgacgccuacguguucgugggcaccucccgguacagcaagaaguucaagcccgagaucgccauccgccccaagguccgggaccaggagggccgcaugaacuacuacuggacccugguggagcccggggacaagaucacguucgaggccaccggcaaccucguggucccccgguacgcguucaccauggagcgcaacgccggguccggcaucaucaucagcgacaccccggugcacgacugcaacacgaccugccagacccccgagggcgccaucaacaccucccugcccuuccagaacauccaccccaucacgaucgggaagugcccgaaguacgucaagagcaccaagcugcggcucgccaccggccugcgcaacgugcccuccauccagagccgggggcuguucggcgccaucgcgggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcuggaccgggagaagaucgacggcgugcgccucgaguccacccggaucuaccagauccuggccaucuacagcaccgucgccuccagccuggugcucguggucucccugggggcgaucagcuucuggaugugcagcaacggcucccugcagugccgcaucugcaucuga

SEQ ID NO: 73386 - RNA, 1701 nt, Artificial Sequence
  derived and/or modified sequence opt1 from hemagglutinin__InfluenzaA__AIC73741
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccacugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacaugggcaacgggugcuucaagaucuaccaccgcugcgacaacgccugcaucggcuccauccggaacgggacguacgaccacaacguguaccgcgacgaggcccucaacaaccgguuccagauccgcggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 73387 - RNA, 1701 nt, Artificial Sequence
  derived and/or modified sequence opt1 from hemagglutinin__InfluenzaA__AIC73742
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugcggcaguccuacaucaacgacaagggcaaggaggugcugguccucugggggauccaccaccccagcaccacgaccgaccagcagagccuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucacguucgaggccaccggcaaccucguggucccccgcuacgcguucaccauggagcggaacgccggguccggcaucaucaucagcgacacccccgugcacgacugcaacacgaccugccagaccccggagggcgccaucaacaccucccugcccuuccagaacauccaccccaucacgaucgggaagugccccaaguacgucaagagcaccaagcugcgccucgccaccggccugcggaacgugccguccauccagagccgcgggcuguucggcgccaucgcgggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgccgugggcaaggaguucaaccaccuggagaagcggaucgagaaccugaaccgcaaggucgacgacggcuuccucgacaucuggacguacaacgcggagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgccuccagccuggugcucguggucucccugggggcgaucagcuucuggaugugcagcaacggcucccugcagugccggaucugcaucuga

SEQ ID NO: 73388 - RNA, 1701 nt, Artificial Sequence; identical to SEQ ID NO: 73387
  derived and/or modified sequence opt1 from hemagglutinin__InfluenzaA__AIC73743

SEQ ID NO: 73389 - RNA, 1701 nt, Artificial Sequence
  derived and/or modified sequence opt1 from hemagglutinin__InfluenzaA__AIC73744
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaaccaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucagcgacacccccgcccacgacugcaacaccacgugccagaccccggagggcgccaucaacaccucccugcccuuccagaacauccaccccaucaccaucgggaagugccccaaguacgucaagagcacgaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucacgaacaaggugaacuccgugaucgagaagaugaacacccaguucaccgccgucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacagcaacgugaagaaccucuacgagaaggugcgcaaccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggagaagaucgacggcgugaagcucgaguccacccgcaucuaccagauccuggcgaucuacagcaccguggccuccagccugguccucguggugucccugggggccaucagcuucuggaugugcagcaacggcucccugcagugccggaucugcaucuga

SEQ ID NO: 73390 - RNA, 1701 nt, Artificial Sequence
  derived and/or modified sequence opt1 from hemagglutinin__InfluenzaA__AIC73745
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacugggcgcugguggagcccggggacaagaucaccuucgaggccaccggcaaccucguggucccccgguacgccuucacgauggagcgcaacgccgggagcggcaucaucaucuccgacacccccgugcacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacaucccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 73391 - RNA, 1701 nt, Artificial Sequence
  derived and/or modified sequence opt1 from hemagglutinin__InfluenzaA__AIC73746
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgcggccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccaccgaccagcagucccuguaccagaacgcggacgccuacguguucgugggcaccagccgguacuccaagaaguucaagcccgagaucgccauccgcccgaagguccgggaccaggagggccgcaugaacuacuacuggacgcugguggagcccggggacaagaucaccuucgaggccaccggcaaccucguggucccccgguacgccuucaccauggagcgcaacgcggggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgccggguucaucgagggcggcuggacggggaugguggacggcugguacggguaccaccaccagaacgagcagggcagcggguacgcggccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgcgaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggccaucagcuucuggaugugcuccaacggcagccugcagugccggaucugcaucuga

SEQ ID NO: 73392 - RNA, 1701 nt, Artificial Sequence
  derived and/or modified sequence opt1 from hemagglutinin__InfluenzaA__AIC73747
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucaacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcugucccagagcuacaucaacgacaagggcaaggaggugcucguccugugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccucguggagcccggggacaagaucaccuucgaggcgacgggcaaccugguggucccccgguacgccuucaccauggagcgcaacaccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcuccggcuggccaccggccugcgcaacgucccgagcauccagucccggggccucuucggggccaucgcgggguucaucgagggcggcuggaccgggaugguggacggcugguacggguaccaccaccagaacgagcagggcagcggguacgccgccgaccugaaguccacgcagaacgccaucgacaagaucaccaacaaggugaacagcgucaucgagaagaugaacacccaguucaccgccgugggcaaggaguucaaccaccuggagaagcgcaucgagaaccucaacaagaaggucgacgacggcuuccuggacaucuggacguacaacgcggagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagagcacccgcaucuaccagauccuggccaucuacuccaccgucgccagcucccucgugcugguggucagccugggggcgaucagcuucuggaugugcuccaacggcagccuccagugccggaucugcaucuga

SEQ ID NO: 73393 - RNA, 1701 nt, Artificial Sequence; identical to SEQ ID NO: 71048
  derived and/or modified sequence opt1 from hemagglutinin__InfluenzaA__AIC73748

SEQ ID NO: 73394 - RNA, 1701 nt, Artificial Sequence
  derived and/or modified sequence opt1 from hemagglutinin__InfluenzaA__AIC73749
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcaagaacugcacccugaucgacgcccugcucggggacccccagugcgacggcuuccagaacaagcggugggaccuguucguggagcgcuccaaggccuacagcaacugcuaccccuacgacgugccggacuacgcgucccugcggagccucgucgccuccagcggcacccuggaguucaacgacgaguccuucaacugggccggggugacgcagaacggcaccagcuccgccugcauccgcgggagcaacuccagcuucuucucccggcugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccacuccagcggccgcaucaccgugagcaccaagcggucccagcaggccgugaucccgaacaucggcagccgcccccggauccgcaacauccccucccggaucagcaucuacuggaccaucgucaagcccggggacauccugcugaucaacuccacgggcaaccucaucgccccgcgcggguacuucaagauccagagcggcaaguccagcaucaugcgguccgacgcccccaucggcaagugcaagagcgagugcaucacccccaacggguccaucaccaacgacaagcccuuccagaacgugaaccgcaucaccuacggcgcgugcccgcgguacgugaagcagagcacgcugaagcuggccaccgggaugcgcaacguccccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagacgaacgagaaguuccaccagaucgagaaggaguucuccgagguggaggggcggauccaggaccucgagaaguacguggaggacaccaagaucgaccuguggagcuacaacgccgagcugcucgucgcccuggagaaccagcacaccaucgaccugaccgacuccgagaugaacaagcuguucgagaagacgaagaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcguggagcucaaguccggcuacaaggacuggauccuguggaucagcuucgccaucagcugcuuccugcucugcgucgcccugcugggguucaucaugugggcgugccagaagggcaacauccggugcaacaucugcaucuga

SEQ ID NO: 73395 - RNA, 1701 nt, Artificial Sequence; identical to SEQ ID NO: 71048
  derived and/or modified sequence opt1 from hemagglutinin__InfluenzaA__AIC73750

SEQ ID NO: 73396 - RNA, 1701 nt, Artificial Sequence
  derived and/or modified sequence opt1 from hemagglutinin__InfluenzaA__AIC73754
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacucccgcaaguucaagcccgagaucgccauccggccgaagguccgcgaccaggagggccggaugaacuacuacuggacccugguggagcccggggacaagaucaccuucgaggcgacgggcaaccucguggucccccgcuacgccuucaccauggagcggaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcgccucgccaccggccugcggaacgucccgagcauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgcgagcucccuggugcucguggucagccugggggccaucagcuucuggaugugcuccaacggcagccugcagugccgcaucugcaucuga

SEQ ID NO: 73397 - RNA, 1701 nt, Artificial Sequence; identical to SEQ ID NO: 71048
  derived and/or modified sequence opt1 from hemagglutinin__InfluenzaA__AIC73755

SEQ ID NO: 73398 - RNA, 1701 nt, Artificial Sequence; identical to SEQ ID NO: 71048
  derived and/or modified sequence opt1 from hemagglutinin__InfluenzaA__AIC73756

SEQ ID NO: 73399 - RNA, 1701 nt, Artificial Sequence; identical to SEQ ID NO: 71048
  derived and/or modified sequence opt1 from hemagglutinin__InfluenzaA__AIC73757

SEQ ID NO: 73400 - RNA, 1701 nt, Artificial Sequence
  derived and/or modified sequence opt1 from hemagglutinin__InfluenzaA__AIC73758
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcugucccagagcuacaucaacgacaagggcaaggaggugcuggugcucugggggauccaccaccccagcaccacggccgaccagcagucccuguaccagaacgccgacgccuacgucuucgugggcaccagccgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 73401 - RNA, 1701 nt, Artificial Sequence
  derived and/or modified sequence opt1 from hemagglutinin__InfluenzaA__AIC73760
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcugucccagagcuacaucaacgacaagggcaaggaggugcuggugcucugggggauccaccaccccagcaccacggccgaccagcagucccuguaccagaacgccgacgccuacgucuucgugggcaccagccgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 73402 - RNA, 1701 nt, Artificial Sequence; identical to SEQ ID NO: 73401
  derived and/or modified sequence opt1 from hemagglutinin__InfluenzaA__AIC73761

SEQ ID NO: 73403 - RNA, 1701 nt, Artificial Sequence; identical to SEQ ID NO: 72928
  derived and/or modified sequence opt1 from hemagglutinin__InfluenzaA__AIC73762

SEQ ID NO: 73404 - RNA, 1701 nt, Artificial Sequence
  derived and/or modified sequence opt1 from hemagglutinin__InfluenzaA__AIC73763
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagaucucccagagcuacaucaacgacaagggcaaggaggugcugguccugugggggauccaccaccccagcaccacggccgaccagcagucccucuaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucaccauggagcgcaacgccgggagcggcaucaucaucuccgacacccccgugcacgacugcaacaccacgugccagaccccggagggcgccaucaacaccagccuccccuuccagaacauccaccccaucaccaucgggaagugccccaaguacgugaaguccacgaagcugcggcuggccaccggccuccgcaacgucccgagcauccagucccgggggcuguucggcgcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacagcgucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgccaucuacuccaccgucgcgagcucccuggugcugguggucagccucggggccaucagcuucuggaugugcuccaacggcagccugcagugccggaucugcaucuga

SEQ ID NO: 73405 - RNA, 1701 nt, Artificial Sequence; identical to SEQ ID NO: 71048
  derived and/or modified sequence opt1 from hemagglutinin__InfluenzaA__AIC73765

SEQ ID NO: 73406 - RNA, 1701 nt, Artificial Sequence; identical to SEQ ID NO: 71048
  derived and/or modified sequence opt1 from hemagglutinin__InfluenzaA__AIC73766

SEQ ID NO: 73407 - RNA, 1701 nt, Artificial Sequence
  derived and/or modified sequence opt1 from hemagglutinin__InfluenzaA__AIC73767
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucaucaagaaggggaacagcuaccccaagcugucccagagcuacaucaacgacaagggcaaggaggugcuggugcucugggggauccaccaccccagcaccacggccgaccagcagucccuguaccagaacgccgacgccuacgucuucgugggcaccagccgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacaucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgucaagaaccucuacgagaagauccgcaaccagcugaagaacaacgccaaggagaucgggaacggcugcuucgaguucuaccacaagugcgacaacaugugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73408 - RNA, 1701 nt, Artificial Sequence; identical to SEQ ID NO: 71048
  derived and/or modified sequence opt1 from hemagglutinin__InfluenzaA__AIC73768

SEQ ID NO: 73409 - RNA, 1701 nt, Artificial Sequence; identical to SEQ ID NO: 71048
  derived and/or modified sequence opt1 from hemagglutinin__InfluenzaA__AIC73769

SEQ ID NO: 73410 - RNA, 1701 nt, Artificial Sequence; identical to SEQ ID NO: 71048
  derived and/or modified sequence opt1 from hemagglutinin__InfluenzaA__AIC73770

SEQ ID NO: 73411 - RNA, 1701 nt, Artificial Sequence; identical to SEQ ID NO: 71048
  derived and/or modified sequence opt1 from hemagglutinin__InfluenzaA__AIC73771

SEQ ID NO: 73412 - RNA, 1701 nt, Artificial Sequence
  derived and/or modified sequence opt1 from hemagglutinin__InfluenzaA__AIC73772
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcgucuaccagauccuggccaucuacuccaccguggcgagcucccuggugcucgucgugagccugggggccaucagcuucuggaugugcuccaacggcagccugcagugccggaucugcaucuga

SEQ ID NO: 73413 - RNA, 1701 nt, Artificial Sequence; identical to SEQ ID NO: 71048
  derived and/or modified sequence opt1 from hemagglutinin__InfluenzaA__AIC73773

SEQ ID NO: 73414 - RNA, 1701 nt, Artificial Sequence; identical to SEQ ID NO: 71048
  derived and/or modified sequence opt1 from hemagglutinin__InfluenzaA__AIC73775

SEQ ID NO: 73415 - RNA, 1701 nt, Artificial Sequence; identical to SEQ ID NO: 71048
  derived and/or modified sequence opt1 from hemagglutinin__InfluenzaA__AIC73776

SEQ ID NO: 73416 - RNA, 1701 nt, Artificial Sequence; identical to SEQ ID NO: 73412
  derived and/or modified sequence opt1 from hemagglutinin__InfluenzaA__AIC73777

SEQ ID NO: 73417 - RNA, 1701 nt, Artificial Sequence
  derived and/or modified sequence opt1 from hemagglutinin__InfluenzaA__AIC73778
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggcccacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 73418 - RNA, 1701 nt, Artificial Sequence; identical to SEQ ID NO: 73417
  derived and/or modified sequence opt1 from hemagglutinin__InfluenzaA__AIC73779

SEQ ID NO: 73419 - RNA, 1701 nt, Artificial Sequence; identical to SEQ ID NO: 73417
  derived and/or modified sequence opt1 from hemagglutinin__InfluenzaA__AIC73780

SEQ ID NO: 73420 - RNA, 1701 nt, Artificial Sequence; identical to SEQ ID NO: 72006
  derived and/or modified sequence opt1 from hemagglutinin__InfluenzaA__AIC73781

SEQ ID NO: 73421 - RNA, 1701 nt, Artificial Sequence; identical to SEQ ID NO: 73417
  derived and/or modified sequence opt1 from hemagglutinin__InfluenzaA__AIC73782

SEQ ID NO: 73422 - RNA, 1701 nt, Artificial Sequence; identical to SEQ ID NO: 73417
  derived and/or modified sequence opt1 from hemagglutinin__InfluenzaA__AIC73783

SEQ ID NO: 73423 - RNA, 1701 nt, Artificial Sequence; identical to SEQ ID NO: 73417
  derived and/or modified sequence opt1 from hemagglutinin__InfluenzaA__AIC73784

SEQ ID NO: 73424 - RNA, 1701 nt, Artificial Sequence; identical to SEQ ID NO: 71048
  derived and/or modified sequence opt1 from hemagglutinin__InfluenzaA__AIC73785

SEQ ID NO: 73425 - RNA, 1701 nt, Artificial Sequence; identical to SEQ ID NO: 73417
  derived and/or modified sequence opt1 from hemagglutinin__InfluenzaA__AIC73786

SEQ ID NO: 73426 - RNA, 1701 nt, Artificial Sequence; identical to SEQ ID NO: 71048
  derived and/or modified sequence opt1 from hemagglutinin__InfluenzaA__AIC73787

SEQ ID NO: 73427 - RNA, 1701 nt, Artificial Sequence; identical to SEQ ID NO: 71048
  derived and/or modified sequence opt1 from hemagglutinin__InfluenzaA__AIC73788

SEQ ID NO: 73428 - RNA, 1701 nt, Artificial Sequence
  derived and/or modified sequence opt1 from hemagglutinin__InfluenzaA__AIC73789
augaagaccaucaucgcccugagcuacauccucugccugguguucgcccagaagcccccgggcaacgacaacuccaccgcgacgcugugccucgggcaccacgccguccccaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuacccguacgacgugcccgacuacgcgucccugcgcagccuggucgccuccagcggcacccucgaguucaacaacgaguccuucaacugggccggggugacgcagaacggcaccagcuccgccugcauccgggggagcaacuccagcuucuucucccgccugaacuggcugacccaccucaacuucaaguaccccgcgcugaacgugaccaugcccaacaacgagcaguucgacaagcuguacaucuggggcguccaccacccggggacggacaaggaccagaucuuccucuacgcccagagcuccggccggaucaccgugagcaccaagcgcagccagcaggccgugauccccaacaucggcucccggccccgcauccggaacauccccagccgcaucuccaucuacuggaccaucgucaagccgggggacauccugcugaucaacagcacgggcaaccucaucgcgccccggggguacuucaagauccgcuccggcaagagcuccaucaugcggagcgacgcccccaucggcaagugcaaguccgagugcaucacccccaacgggagcaucccgaacgacaagcccuuccagaacgugaaccgcaucaccuacggcgccugcccccgguacgugaagcaguccacccugaagcuggccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacgucgaggacacgaagaucgaccugugguccuacaacgccgagcugcucguggcccuggagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcucugcguggugcugcugggguucaucaugugggccugccagaagggcaacauccggugcaacaucugcaucuga

SEQ ID NO: 73429 - RNA, 1701 nt, Artificial Sequence
  derived and/or modified sequence opt1 from hemagglutinin__InfluenzaA__AIC73790
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugcggcaguccuacaucaacgacaagggcaaggaggugcugguccucugggggauccaccaccccagcacgaccaccgaccagcagagccuguaccagaacgcggacgccuacguguucgugggcaccucccgcuacagcaagaaguucaagcccgagaucgccauccggccgaagguccgcgaccaggagggccggaugaacuacuacuggacgcugguggagcccggggacaagaucaccuucgaggccaccggcaaccucguggucccccgcuacgccuucaccauggagcggaacgcgggguccggcaucaucaucagcgacacgcccgugcacgacugcaacacgaccugccagaccccggagggcgccaucaacaccucccugcccuuccagaacauccaccccaucaccaucgggaagugccccaaguacgucaagagcaccaagcugcgccucgccaccggccugcggaacgugccguccauccagagccgcgggcuguucggcgccaucgccggguucaucgagggcggcuggacggggaugguggacggcugguacggguaccaccaccagaacgagcagggcuccggguacgcggccgaccucaagagcacccagaacgccaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggaaccagcugaagaacaacgcgaaggagaucgggaacggcugcuucgaguucuaccacaagugcgacaacacgugcauggaguccgugaagaacgggaccuacgacuaccccaaguacagcgaggaggccaagcugaaccgcgagaagaucgacggcgugaagcucgaguccacccggaucuaccagauccuggccaucuacagcaccgucgccuccagccuggugcucguggucucccugggggccaucagcuucuggaugugcagcaacggcucccugcagugccgcaucugcaucuga

SEQ ID NO: 73430 - RNA, 1701 nt, Artificial Sequence
  derived and/or modified sequence opt1 from hemagglutinin__InfluenzaA__AIC73791
augaaggccauccuggugguccuccuguacaccuucgccaccgcgaacgccgacacgcugugcaucggcuaccacgccaacaacagcaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcugucccagagcuacaucaacgacaagggcaaggaggugcuggugcucugggggauccaccaccccagcaccacggccgaccagcagucccuguaccagaacgccgacgccuacgucuucgugggcaccagccgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 73431 - RNA, 1701 nt, Artificial Sequence; identical to SEQ ID NO: 71048
  derived and/or modified sequence opt1 from hemagglutinin__InfluenzaA__AIC73792

SEQ ID NO: 73432 - RNA, 1701 nt, Artificial Sequence; identical to SEQ ID NO: 73412
  derived and/or modified sequence opt1 from hemagglutinin__InfluenzaA__AIC73793

SEQ ID NO: 73433 - RNA, 1701 nt, Artificial Sequence
  derived and/or modified sequence opt1 from hemagglutinin__InfluenzaA__AIC73794
augaagaccaucaucggcgugagcuacauccugugccucgucuucgcccagaagcugcccgggaacgacaacuccaccgccacgcugugccucggccaccacgcggugccgaacgggaccaucgugaagaccaucaccaacgaccgcaucgaggucacgaacgccaccgagcuggugcagaacagcuccaucggcgagaucugcgacagcccccaccagauccuggacggggagaacugcacccucaucgacgcccugcugggcgacccccagugcgacggcuuccagaacaagaagugggaccucuucguggagcgguccaaggccuacagcaacugcuaccccuacgacgucccggacuacgccucccugcgcagccugguggcguccagcgggacccucgaguucaacaacgaguccuucaacugggccggcgugacgcagaacgggaccagcuccagcugcauccggggcuccaacagcuccuucuucagccgccugaacuggcugacccaccucaacuccaaguaccccgcccugaacgucaccaugcccaacaacgagcaguucgacaagcuguacaucuggggcgugcaccaccccgggacggacaaggaccagaucuuccucuacgcccagagcagcggccggaucaccguguccaccaagcgcagccagcaggcggucaucccgaacaucgggucccggccccgcauccgggacauccccagccgcaucuccaucuacuggaccaucgugaagcccggcgacauccugcugaucaacagcacggggaaccucaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgucaagcaguccacccugaagcuggccacgggcaugcgcaacgugcccgagcggcagacccgcgggaucuucggcgcgaucgccggcuucaucgagaacgggugggagggcaugguggacgggugguacggcuuccggcaccagaacagcgaggggcgcggccaggccgccgaccucaaguccacccaggccgcgaucgaccagaucaacggcaagcugaaccggcugaucgggaagaccaacgagaaguuccaccagaucgagaaggaguucagcgaggucgagggccgcauccaggaccucgagaaguacguggaggacacgaagaucgaccugugguccuacaacgccgagcugcucguggcccuggagaaccagcacaccaucgaccugaccgacagcgagaugaacaagcuguucgagaagaccaagaagcagcuccgcgagaacgccgaggacauggggaacggcugcuucaagaucuaccacaagugcgacaacgccugcaucggguccauccggaacggcacguacgaccacgacgucuaccgcgacgaggcgcugaacaaccgguuccagaucaagggcguggagcucaagagcggguacaaggacuggauccuguggaucagcuucgccaucuccugcuuccugcucugcguggcccugcugggcuucaucaugugggccugccagaaggggaacauccgcugcaacaucugcaucuga

SEQ ID NO: 73434 - RNA, 1701 nt, Artificial Sequence; identical to SEQ ID NO: 71048
  derived and/or modified sequence opt1 from hemagglutinin__InfluenzaA__AIC73796

SEQ ID NO: 73435 - RNA, 1701 nt, Artificial Sequence
  derived and/or modified sequence opt1 from hemagglutinin__InfluenzaA__AIC73797
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagagcagcggccggaucaccguguccaccaagcgcagccagcaggccgugaucccgaacaucggcucccggccccgcauccgggacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagcggcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcgucgagcucaagagcggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 73436 - RNA, 1701 nt, Artificial Sequence; identical to SEQ ID NO: 73435
  derived and/or modified sequence opt1 from hemagglutinin__InfluenzaA__AIC73798

SEQ ID NO: 73437 - RNA, 1701 nt, Artificial Sequence; identical to SEQ ID NO: 73435
  derived and/or modified sequence opt1 from hemagglutinin__InfluenzaA__AIC73800

SEQ ID NO: 73438 - RNA, 1701 nt, Artificial Sequence; identical to SEQ ID NO: 73435
  derived and/or modified sequence opt1 from hemagglutinin__InfluenzaA__AIC73801

SEQ ID NO: 73439 - RNA, 1701 nt, Artificial Sequence; identical to SEQ ID NO: 73435
  derived and/or modified sequence opt1 from hemagglutinin__InfluenzaA__AIC73802

SEQ ID NO: 73440 - RNA, 1701 nt, Artificial Sequence; identical to SEQ ID NO: 73435
  derived and/or modified sequence opt1 from hemagglutinin__InfluenzaA__AIC73803

SEQ ID NO: 73441 - RNA, 1701 nt, Artificial Sequence; identical to SEQ ID NO: 73435
  derived and/or modified sequence opt1 from hemagglutinin__InfluenzaA__AIC73804

SEQ ID NO: 73442 - RNA, 1701 nt, Artificial Sequence; identical to SEQ ID NO: 73435
  derived and/or modified sequence opt1 from hemagglutinin__InfluenzaA__AIC73805

SEQ ID NO: 73443 - RNA, 1701 nt, Artificial Sequence; identical to SEQ ID NO: 73435
  derived and/or modified sequence opt1 from hemagglutinin__InfluenzaA__AIC73806

SEQ ID NO: 73444 - RNA, 1701 nt, Artificial Sequence
  derived and/or modified sequence opt1 from hemagglutinin__InfluenzaA__AIC73807
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacaacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73445 - RNA, 1701 nt, Artificial Sequence; identical to SEQ ID NO: 73435
  derived and/or modified sequence opt1 from hemagglutinin__InfluenzaA__AIC73808

SEQ ID NO: 73446 - RNA, 1701 nt, Artificial Sequence
  derived and/or modified sequence opt1 from hemagglutinin__InfluenzaA__AIC73809
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugcggcaguccuacaucaacgacaagggcaaggaggugcugguccucugggggauccaccaccccagcaccacgaccgaccagcagagccuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucacguucgaggccaccggcaaccucguggucccccgcuacgcguucaccauggagcggaacgccggguccggcaucaucaucagcgacacccccgugcacgacugcaacacgaccugccagaccccggagggcgccaucaacaccucccugcccuuccagaacauccaccccaucacgaucgggaagugccccaaguacgucaagagcaccaagcugcgccucgccaccggccugcggaacgugccguccauccagagccgcgggcuguucggcgccaucgcgggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgcggagcugcuggugcuccuggagaacgagcgcacccuggacuaccacgacagcaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgagaagaucgacgaggugaagcucgaguccacccggaucuaccagauccuggccaucuacagcaccgucgccuccagccuggugcucguggucucccugggcgcgaucagcuucuggaugugcagcaacgggucccugcagugccgcaucugcaucuga

SEQ ID NO: 73447 - RNA, 1701 nt, Artificial Sequence
  derived and/or modified sequence opt1 from hemagglutinin__InfluenzaA__AIC73810
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccaccggugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgcgagcucccuggugcucguggucagccugggggccaucagcuucuggaugugcuccaacggcagccugcagugccgcaucugcaucuga

SEQ ID NO: 73448 - RNA, 1701 nt, Artificial Sequence
  derived and/or modified sequence opt1 from hemagglutinin__InfluenzaA__AIC73813
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgcggccagcucccugguccucgugaucagccugggggccaucagcuucuggaugugcuccaacggcagccugcagugccggaucugcaucuga

SEQ ID NO: 73449 - RNA, 1701 nt, Artificial Sequence
  derived and/or modified sequence opt1 from hemagglutinin__InfluenzaA__AIC73815
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 73450 - RNA, 1701 nt, Artificial Sequence; identical to SEQ ID NO: 72928
  derived and/or modified sequence opt1 from hemagglutinin__InfluenzaA__AIC73817

SEQ ID NO: 73451 - RNA, 1701 nt, Artificial Sequence; identical to SEQ ID NO: 71048
  derived and/or modified sequence opt1 from hemagglutinin__InfluenzaA__AIC73819

SEQ ID NO: 73452 - RNA, 1701 nt, Artificial Sequence
  derived and/or modified sequence opt1 from hemagglutinin__InfluenzaA__AIC73820
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacaucgaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 73453 - RNA, 1701 nt, Artificial Sequence; identical to SEQ ID NO: 71048
  derived and/or modified sequence opt1 from hemagglutinin__InfluenzaA__AIC73821

SEQ ID NO: 73454 - RNA, 1701 nt, Artificial Sequence; identical to SEQ ID NO: 73412
  derived and/or modified sequence opt1 from hemagglutinin__InfluenzaA__AIC73824

SEQ ID NO: 73455 - RNA, 1701 nt, Artificial Sequence; identical to SEQ ID NO: 71048
  derived and/or modified sequence opt1 from hemagglutinin__InfluenzaA__AIC73825

SEQ ID NO: 73456 - RNA, 1701 nt, Artificial Sequence
  derived and/or modified sequence opt1 from hemagglutinin__InfluenzaA__AIC73827
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagccccugagcaccgcguccagcugguccuacaucguggagaccagcuccagcgacaacggcacgugcuaccccggcgacuucaucaacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagccaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagccggagaucgccauccgccccaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucagcgacaccccggugcacgacugcaacaccacgugccagacccccgagggcgccaucaacaccucccugcccuuccagaacauccaccccaucaccaucgggaagugcccgaaguacgucaagagcacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccugauccucguggugucccugggggccaucagcuucuggaugugcagcaacggcucccugcagugccggaucugcaucuga

SEQ ID NO: 73457 - RNA, 1701 nt, Artificial Sequence
  derived and/or modified sequence opt1 from hemagglutinin__InfluenzaA__AIC73828
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaccaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgcggccagcucccugguccucguggugagccugggggccaucagcuucuggaugugcuccaacggcagccugcagugccggaucugcaucuga

SEQ ID NO: 73458 - RNA, 1701 nt, Artificial Sequence
  derived and/or modified sequence opt1 from hemagglutinin__InfluenzaA__AIC73830
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgcuacuccaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucaccauggagcggaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcgccucgccaccggccugcggaacgucccgagcauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgcgagcucccuggugcucguggucagccugggggccaucagcuucuggaugugcuccaacggcagccugcagugccgcaucugcaucuga

SEQ ID NO: 73459 - RNA, 1701 nt, Artificial Sequence
  derived and/or modified sequence opt1 from hemagglutinin__InfluenzaA__AIC73833
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgcggccagcucccugguccucguggugagccugggggccaucagcuucuggaugugcuccaacggcagccugcagugccggaucugcaucuga

SEQ ID NO: 73460 - RNA, 1701 nt, Artificial Sequence
  derived and/or modified sequence opt1 from hemagglutinin__InfluenzaA__AIC73834
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgacggcgccaaguccuucuacaagaaccugaucuggcucgugaagaaggggaacagcuaccccaagcugucccagagcuacaucaacgacaagggcaaggaggugcugguccucugggggauccaccaccccagcaccacggcgggccagcagucccuguaccagaacgccgacgccuacguguucgugggcaccagccgguacuccaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucaccauggagcgcaacgccggcagcggcaucaucaucuccgacacccccgugcacgacugcaacaccacgugccagaccccggagggggccaucaacaccagccugcccuuccagaacauccaccccaucaccaucggcaagugccccaaguacgugaaguccacgaagcugcggcucgccaccgggcugcgcaacgucccgagcauccagucccggggccuguucggggccaucgcgggcuucaucgagggcggguggaccggcaugguggacgggugguacggcuaccaccaccagaacgagcaggggagcggcuacgccgccgaccucaaguccacccagaacgccaucgacaagaucacgaacaaggugaacagcgucaucgagaagaugaacacccaguucaccgccgugggcaaggaguucaaccaccuggagaagcgcaucgagaaccugaacaagaaggucgacgacggguuccucgacaucuggaccuacaacgcggagcugcuggugcuccuggagaacgagcggacgcuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggagaagaucgacggggugaagcucgagagcacccgcaucuaccagauccuggccaucuacuccaccgucgccagcucccuggugcucguggucagccugggcgcgaucagcuucuggaugugcuccaacggcagccugcagugccggaucugcaucuga

SEQ ID NO: 73461 - RNA, 1701 nt, Artificial Sequence
  derived and/or modified sequence opt1 from hemagglutinin__InfluenzaA__AIC73835
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucaccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagccuguggaugugcuccaacggcagccuccagugccggaucugcaucuga

SEQ ID NO: 73462 - RNA, 1701 nt, Artificial Sequence; identical to SEQ ID NO: 73404
  derived and/or modified sequence opt1 from hemagglutinin__InfluenzaA__AIC73836

SEQ ID NO: 73463 - RNA, 1701 nt, Artificial Sequence
  derived and/or modified sequence opt1 from hemagglutinin__InfluenzaA__AIC73837
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugaaggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 73464 - RNA, 1701 nt, Artificial Sequence
  derived and/or modified sequence opt1 from hemagglutinin__InfluenzaA__AIC73838
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccagcggccggaucaccgugagcaccaagcgcucccagcaggccgugaucccgaacaucggcagccggccccgcauccggaacauccccucccgcaucagcaucuacuggaccaucgucaagcccggggacauccugcugaucaacuccacgggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacggcugggaggggaugauggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggaccugggcaacgggugcuucaagaucuaccacaagugcgacaacgccugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggcgugccagaagggcaacauccggugcaacaucugcaucuga

SEQ ID NO: 73465 - RNA, 1701 nt, Artificial Sequence
  derived and/or modified sequence opt1 from hemagglutinin__InfluenzaA__AIC73839
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73466 - RNA, 1701 nt, Artificial Sequence; identical to SEQ ID NO: 71048
  derived and/or modified sequence opt1 from hemagglutinin__InfluenzaA__AIC73840

SEQ ID NO: 73467 - RNA, 1701 nt, Artificial Sequence
  derived and/or modified sequence opt1 from hemagglutinin__InfluenzaA__AIC73841
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccaucgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccgggagcggcaucaucaucuccgacacccccgugcacgacugcaacacgaccugccagaccccggagggcgccaucaacaccagccugcccuuccagaacauccaccccaucaccaucgggaagugccccaaguacgugaaguccaccaagcugcggcucgccacgggccugcgcaacaucccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucaccaacaaggugaacagcgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 73468 - RNA, 1701 nt, Artificial Sequence; identical to SEQ ID NO: 73463
  derived and/or modified sequence opt1 from hemagglutinin__InfluenzaA__AIC73842

SEQ ID NO: 73469 - RNA, 1707 nt, Artificial Sequence
  derived and/or modified sequence opt1 from hemagglutinin__InfluenzaA__AID48082
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaaccaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacgacgagugcauggagagcgugcggaacggcaccuacgacuacccccaguacuccgaggaggcccgccucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcaucuga

SEQ ID NO: 73470 - RNA, 1701 nt, Artificial Sequence
  derived and/or modified sequence opt1 from hemagglutinin__InfluenzaA__AID70444
augaaggccgugcuggucgugcuccuguacaccuucgccaccgcgaacgccgacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuggccaccgccuccagcugguccuacaucguggagaccagcaacuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgcgggcgccaaguccuucuacaagaaccugaucuggcucgugaagaaggggaacagcuaccccaagcuguccaagagcuacaucaacgacaagggccgggagguccuggugcucugggggauccaccaccccuccaccagcgccgaccagcagagccuguaccagaacgccgacacguacguguucgucggcaccucccgcuacagcaagaaguucaagcccgagaucgccauccggccgaaggugcgcgaccaggagggccggaugaacuacuacuggacccugguggagcccggggacaagaucaccuucgaggcgacgggcaaccucgucgugccccgcuacgccuucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcgccucgcgacgggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggucaacuccgugaucgagaagaugaacacgcaguucaccgccgucggcaaggaguucaaccaccuggagaagcggaucgagaaccugaacaagaagguggacgacggcuuccucgacaucuggaccuacaacgccgagcugcuggugguccucgagaacgagcgcacccuggaguaccacgacagcaacgugaagaaccuguacgagaaggugcggucccaggucaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcucccucgugcugguggucagccugggggccaucagcuucuggaugugcuucaacggcucccuccagugccgcaucuacaucuga

SEQ ID NO: 73471 - RNA, 1701 nt, Artificial Sequence
  derived and/or modified sequence opt1 from hemagglutinin__InfluenzaA__AID70445
augaaggccauccuggugguccuccuguacaccuucgccaccgcgaacgccgacacccugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcugguggugcucgagaacgagcggacgcuggaguaccacgacuccaacgucaagaaccuguacgagaaggugcgcaaccagcucaagaacaacgccaaggagaucgggaacggcugcuucgaguucuaccacaagugcgacaacacgugcauggagagcgugaagaacgggaucuacgacuaccccaaguacuccgaggaggccaagcugaaccgggaggagaucgacggcgucaagcuggagagcacccgcaucuaccagauccucgccaucuacuccaccguggcgagcucccuggugcaggucgugagccugggggccaucagcuucuggaugugcuucaacggcucccuccagugccggaucugcaucuga

SEQ ID NO: 73472 - RNA, 1701 nt, Artificial Sequence
  derived and/or modified sequence opt1 from hemagglutinin__InfluenzaA__AID70446
augaaggccgugcuggucgugcuccuguacaccuucgccaccgcgaacgccgacacccugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagauccugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccggcacccccgugcacgacugcaacaccacgugccagaccccgaagggggccaucaacaccagccugcccuuccagaacauccaccccaucaccaucggcaagugccccaaguacgugaaguccacgaagcugcggcucgccaccgggcugcgcaacgucccgagcauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggguuccucgacaucuggaccuacaacgccgagcugcugguggugcucgagaacgagcggacgcuggaguaccacgacuccaacgucaagaaccuguacgagaaggugcgcaaccagcucaagaacaacgccaaggagaucggcaacgggugcuucgaguucuaccacaagugcgacaacacgugcauggagagcgugaagaacggcaucuacgacuaccccaaguacuccgaggaggccaagcugaaccgggaggagaucgacggggucaagcuggagagcacccgcaucuaccagauccucgccaucuacuccaccguggcgagcucccuggugcaggucgugagccugggcgccaucagcuucuggaugugcuucaacggcucccuccagugccggaucugcaucuga

SEQ ID NO: 73473 - RNA, 1701 nt, Artificial Sequence
  derived and/or modified sequence opt1 from hemagglutinin__InfluenzaA__AID70447
augaaggccauccuggugguccuccuguacaccuucgccaccgcgaacgccgacacccugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaagggguucuacaagaaccugcucuggcuggugaagaagggcaacuccuaccccaagcugagcaaguccuacaucaacgacaaggggaaggaggugcucguccuguggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccucguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcuccggcuggccaccgggcugcgcaacgugccguccauccagagccggggccucuucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccagcgugggcaaggaguucaaccaccuggagaagcgcauggagaaccugaacaagaaggucgacgacggguuccuggacaucuggaccuacaacgcggagcugcucguggugcuggagaacgagcggacgcuggaguaccacgacuccaacgucaagaaccucuacgagaaggugcgcaaccagcugaagaacaacgccaaggagaucggcaacgggugcuucgaguucuaccacaagugcgacaacacgugcauggagagcgugaagaacggcaucuacgacuaccccaaguacuccgaggaggccaagcugaaccgggaggagaucgacggggucaagcucgagagcacccgcaucuaccagauccuggccaucuacuccaccguggccagcucccuggugcucgucgugagccugggcgcgaucagcuucuggaugugcuucaacggcucccugcagugccggaucugcaucuga

SEQ ID NO: 73474 - RNA, 1701 nt, Artificial Sequence
  derived and/or modified sequence opt1 from hemagglutinin__InfluenzaA__AID70448
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucaccauggagcgcgacgccggcuccggcaucaucaucagcgacacccccgugcacgacugcaacacgaccugccagaccccgaagggggccaucaacaccucccugcccuuccagaacauccaccccaucacgaucggcaagugccccaaguacgucaagagcaccaagcugcggcucgccaccgggcugcgcaacgugccguccauccagagccggggccuguucggggccaucgcgggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggguuccucgacaucuggacguacaacgcggagcugcugguggugcucgagaacgagcggacccuggaguaccaggacagcaacgucaagaaccuguacgagaaggugcgcaaccagcucaagaacaacgccaaggagaucggcaacgggugccuggaguucuaccacaaguucgacaacacgugcauggaguccgugaagaacggcaccuacgacuaccccaaguacagcgaggaggccaagcugaaccgggagaagaucgacggggucaagcucgaguccacccgcaucuaccagauccuggccaucuacagcaccguggccuccagccuggugcucgucgugucccugggcaccaucagcuucuggaugugcuucaacggcagccugcagugccggaucugcaucuga

SEQ ID NO: 73475 - RNA, 1701 nt, Artificial Sequence
  derived and/or modified sequence opt1 from hemagglutinin__InfluenzaA__AID70449
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcugguggugcucgagaacgagcggacgcuggaguaccacgacuccaacgucaagaaccuguacgagaaggugcgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagagcacccgcaucuaccagauccucgccaucuacuccaccguggcgagcucccuggugcuggucgugagccucggggccaucagcuucuggaugugcuucaacggcucccugcagugccggaucugcguguga

SEQ ID NO: 73476 - RNA, 1701 nt, Artificial Sequence
  derived and/or modified sequence opt1 from hemagglutinin__InfluenzaA__AID70450
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcgacgccggcuccggcaucaucaucagcgacacccccgugcacgacugcaacaccacgugccagaccuccaagggggccaucaacaccagccugccguuccagaacauccaccccaucaccaucggcaagugccccaaguacgugaaguccacgaagcugcggcucgccaccgggcugcgcaacguccccagcauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggguuccucgacaucuggaccuacaacgccgagcugcugguggugcucgagaacgagcggacgcuggaguaccacgacuccaacgucaagaaccuguacgagaaggugcgcaaccagcucaagaacaacgccaaggagaucggcaacgggugcuucgaguucuaccacaaguucgacaacacgugcauggagagcgugaagaacggcaccuacgacuacccgaaguacuccgaggaggccaagcugaaccgggagaagaucgacggggucaagcuggagagcacccgcaucuaccagauccucgccaucuacuccaccguggcgagcucccuggugcaggucgugagccugggcgccaucagcuucuggaugugcuucaacggcucccuccagugccggaucugcaucuga

SEQ ID NO: 73477 - RNA, 1701 nt, Artificial Sequence
  derived and/or modified sequence opt1 from hemagglutinin__InfluenzaA__AID70451
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccacggccgaccagcagagccucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccugguggugcuggagaacgagcggacgcucgaguaccacgacagcaacgucaagaaccuguacgagaaggugcgcaaccagcugaagaacaacgccaaggagaucggcaacgggugcuucgaguucuaccacaaguucgacaacacgugcauggaguccgugaagaacggcaccuacgacuaccccaaguacagcgaggaggccaagcucaaccgggaggagaucgacggggucaagcuggaguccacccgcaucuaccagauccuggccaucuacagcaccguggcguccagccucgugcuggucgugucccugggcgccaucagcuucuggaugugcuucaacggcagccuccagugccggaucugcaucuga

SEQ ID NO: 73478 - RNA, 1701 nt, Artificial Sequence
  derived and/or modified sequence opt1 from hemagglutinin__InfluenzaA__AID70452
augaaggccauccuggugguccuccuguacaccuucgccaccgcgaacgccgacacccugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcuggggagcguguccagcuucaagcgcuucgagaucuuccccaagaccuccagcuggcccaaccacgacuccaacaagggcgucaccgccgccugcccgcacgccggggcgaagggcuucuacaagaaccugaucuggcucgugaagaaggggaacagcuaccccaagcuguccaagagcuacaucaacgacaagggcaaggaggugcugguccucuggggcauccaccaccccuccaccacggccgaccagcagagccuguaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcgacgccggcagcgggaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggcuucaucgagggcggguggaccgggaugguggacggcugguacggguaccaccaccagaacgagcagggcagcggcuacgccgccgaccucaaguccacccagaacgccaucgacaagaucacgaacaaggugaacagcgucaucgagaagaugaacacccaguucaccgcgguggggaaggaguucaaccaccuggagaagcgcaucgagaaccugaacaagaaggucgacgacggcuuccucgacaucuggaccuacaacgccgagcugcugguggugcucgagaacgagcggacgcuggaguaccacgacuccaacgucaagaaccuguacgagaaggugcgcaaccagcucaagaacaacgccaaggagaucgggaacggcugcuucgaguucuaccacaagugcgacaacacgugcauggagagcgugaagaacgggaucuacgacuaccccaaguacuccgaggaggccaagcugaaccgggagaagaucgacggcgucaagcuggagagcacccgcaucuaccagauccucgccaucuacuccaccguggcgagcucccuggugcuggucgugagccucggcgccaucuccuucuggaugcgguucaacgggagccugcagugcagcaucugcaucuga

SEQ ID NO: 73479 - RNA, 1701 nt, Artificial Sequence
  derived and/or modified sequence opt1 from hemagglutinin__InfluenzaA__AID70453
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcgacgccggcuccggcaucaucaucagcgacacccccgugcaggacugcaacaccacgugccagaccccgaagggggccaucaacaccucccugcccuuccagaacauccaccccaucaccaucggcaagugccccaaguacgucaagagcacgaagcugcggcucgugaccgggcugcgcaacgugccguccauccagagccggggccuguucggggccaucgcgggcuucaucgagggcggguggaccggcaugguggacgggugguacggcuaccaccaccagaacgagcagggguccggcuacgccgccgaccucaagagcacccagaacgccaucgacaagaucacgaacaaggucaacuccgugaucgagaagaugaacacccaguucaccgccgucggcaaggaguucaaccaccuggagaagcgcaucgagaaccugaacaagaagguggacgacggguuccucgacaucuggaccuacaacgcggagcugcuggugguccucgagaacgagcggacgcuggaguaccacgacagcaaccugaagaaccucuacgagaaggugcgcaaccagcugaagaacaacgccaaggagaucggcaacgggugcuucgaguucuaccacaaguucgacaacacgugcauggaguccgugaagaacggcaccuacgacuaccccaaguacagcgaggaggccaagcugaaccgggaggagaucgacggggucaagcucgaguccacccgcaucuaccagauccuggccaucuacagcaccguggccuccagccuggugcaggucgugucccucggcgcgaucagcuucuggaugcgguucaacggcagccugcacugccgcaucugcaucuga

SEQ ID NO: 73480 - RNA, 1701 nt, Artificial Sequence
  derived and/or modified sequence opt1 from hemagglutinin__InfluenzaA__AID70454
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagaugcggcuggcgacgggccuccgcaacgucccgugcauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccuggacaucuggaccuacaacgccgagcuccugguggugcuggagaacgagcggacccucgacuaccacgacagcaacgucaagaaccuguacgagaaggugcgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgucaagcuggaguccacccgcaucuaccagauccuggcgaucuacagcaccguggccuccagccucgugcuggucgugucccugggggccaucagcuucuggaugugcagcaacggcucccuccagugccggaucugcaucuga

SEQ ID NO: 73481 - RNA, 1701 nt, Artificial Sequence
  derived and/or modified sequence opt1 from hemagglutinin__InfluenzaA__AID70455
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgcgagcagcugagcuccgugagcuccuucgagcgguucgagaucuuccccaagaccagcuccuggcccaaccacgacagcaacaagggcgucaccgccgccugcccgcacgccggggcgaagggcuucuacaagaaccugaucuggcucgugaagaaggggaacuccuaccccaagaucagcaaguccuacaucaacgacaagggcaaggaggugcugguccuguggggcauccaccaccccagcaccacggccgaccagcagagccucuaccagaacgccgacaccuacaucuucguggggaccucccgcuacagcaagaaguucaagcccgagaucgccauccggccgaaggugcgcgaccaggagggccggaugaacuacuacuggacccuggucgagcccggggacaagaucacguucgaggccaccggcaaccugguggugccccgcuacgcguucgccauggagcgggacgccggcuccgggaucaucaucagcgacacccccguccacgacugcaacaccacgugccagaccccgaagggcgccaucaacaccucccuccccuuccagaacauccaccccaucaccaucgggaagugccccaaguacgucaagagcacgaagcugcgccuggccaccggccuccggaacgugccguccauccagagccgcgggcuguucggcgcgaucgccggcuucaucgagggcggguggaccgggaugguggacggcugguacggguaccaccaccagaacgagcagggcuccggcuacgccgccgaccucaagagcacccagaacgccaucgacaagaucacgaacaaggugaacuccgugaucaagaagaugaacacccaguucaccgcggucgggaaggaguucaaccaccuggagaagcggaucgagaaccugaacaagaagguggacgacggcuuccuggacaucuggaccuacaacgccgagcuccuggucgugcuggagaacgagcgcacgcucgaguaccacgacagcaacgugaagaaccuguacgagaagguccggaaccagcugaagaacaacgccaaggagaucgggaacggcugcuucgaguucuaccacaaguucgacaacacgugcauggaguccgugaagaacgggaccuacgacuaccccaaguacagcgaggaggccaagcucaaccgcgaggagaucgacggcgugaagcuggaguccacccggaucuaccagauccuggccaucuacagcaccgucgcguccagccucgugcugguggucucccugggcgccaucagcuucuggaugugcuucaacgggagccuccagugccgcaucugcaucuga

SEQ ID NO: 73482 - RNA, 1701 nt, Artificial Sequence
  derived and/or modified sequence opt1 from hemagglutinin__InfluenzaA__AID70456
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcgguggucaaggaguucaaccaccuggagaagcgcaucgagaaccugaacaagaagguggacgacggcuuccucgacaucuggaccuacaacgccgagcugcuggugguccucgagaacgagcggacgcuggaguaccacgacuccaaccugaagaaccucuacgagaaggugcgcaaccagcugaagaacaacgccaaggagaucggcaacgggugcuucgaguucuaccacaaguucgacaacacgugcauggagagcgugaagaacggcaccuacgacuaccccaaguacuccgaggaggccaagcugaaccgggaggagaucgacggggucaagcucgagagcacccgcaucuaccagauccuggccaucuacuccaccguggcgagcucccuggugcaggucgugagccucggcgccaucagcuucuggaugugcuucaacgggucccugcagugccggaucugcaucuga

SEQ ID NO: 73483 - RNA, 1701 nt, Artificial Sequence
  derived and/or modified sequence opt1 from hemagglutinin__InfluenzaA__AID70457
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcgacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcugguggugcucgagaacgagcggacgcuggaguaccacgacagcaacgucaagaaccuguacgagaaggugcgcaaccagcucaagaacaacgccaaggagaucggcaacgggugcuucgaguucuaccacaaguucgacaacacgugcauggaguccgugaagaacggcaccuacgacuaccccaaguacagcgaggaggccaagcugaaccgggagaagaucgacggggucaagcuggaguccacccgcaucuaccagauccucgccaucuacagcaccguggcguccagccuggugcaggucgugucccugggcgccaucagcuucuggaagugcuucaacggcagccuccagugccggaucugcuccuga

SEQ ID NO: 73484 - RNA, 1701 nt, Artificial Sequence
  derived and/or modified sequence opt1 from hemagglutinin__InfluenzaA__AID70458
augaagaccaucaucgcccugagcuacauccucugccugguguucgcccagaaguuccccggcaacgacaacuccauggcgacccugugccucgggcaccacgccgucccgaacggcacgauggugaagaccaucaccaacgaccagaucgaggugaccaacgccacggagcugguccagagcuccagcaccgggggcaucugcaacagcccccaccagauccuggacgggggcaacugcacccucaucgacgcccugcugggcgacccccagugcgacggguuccagaacaagaagugggaccucuucguggagcgcuccaaggccuacuccaacugcuaccccuacgacgugccggacuacgcgagccugcgguccaucgucgccagcuccggcacccuggaguucaacaacgagagcuucaacuggacgggggugacccagaacggcaaguccgccagcugcaagcgcggguccgacaacagcuucuucucccggcucaacuggcugacccaccugaacuacaaguaccccgcccucaaggugaccaugcccaacaacgagaaguucgacaagcuguacaucuggggcguccaccaccccggcacguacaacgaccagaucagccuguacgcgcaggccuccgggaucaucaccgugagcaccaagcgcaaccagcagaccgugaucccgaacaucggcagccggccccgcguccgggacauccccucccgcaucagcaucuacuggacgaucgugaagcccggggacauccuccugaucaacuccaccggcaaccugaucgccccgcggggcuacuucaagauccagagcgggaaguccagcaucaugcgcuccgacgcccccaucggcaagugcaacagcgagugcaucacccccaacggguccauccccaacgacaagccguuccagaacgugaaccggaucaccuacggcgccugcccccgcuacgucaagcagaacacgcucaagcuggcgaccgggaugcggaacgugcccgagaagcagacccgcggcaucuucggcgccaucgccggguucaucgagaacggcugggaggggaugguggacggcugguacggguuccggcaccagaacagcgagggcaugggccaggccgccgaccugaaguccacccaggcggccaucaaccagaucaacgggaagcucaaccgccugaucggcaagacgaucgagaaguuccaccagaucgagaaggaguucagcgaggucgaggggcggauccaggaccuggagaaguacguggaggacaccaagaucgaccucugguccuacaacgccgagcugcugguggcccucgagaaccagcacaccaucgaccugaccgacagcgagauggacaagcuguucgagcgcacgaagaagcagaugcgggagaacgccgaggacaugggcaacgggugcuucaagaucuaccacaagugcgacaacgcgugcaucggcuccauccgcaacggcaucuacgaccgggacaucuaccgcgacgaggcccucagcaaccgcuuccagaucaagggggucgagcugaaggccggcuacaaggacuggauccuguggaucuccuucgccaucagcugcuuccuccugugcguggugcugcucggguucaucaugugggccugccagaagggcaaccugcggugcaacaucugcaucuga

SEQ ID NO: 73485 - RNA, 1701 nt, Artificial Sequence
  derived and/or modified sequence opt1 from hemagglutinin__InfluenzaA__AID70459
augaagaccaucaucgcccugagcuacauccucugccugguguucgcccagaagguccccggcaacgacaacuccaccgcgacgcugugccucgggcaccacgccgugccgaacggcaccaucgugaagaccaucaccaacgaccagaucgaggucacgaacgccaccgagcuggugcagagcuccagcaccggggagaucugcaacagcccccaccagauccuggacggcgagaacugcacccucaucgacgcccugcugggggacccccagugcgacggcuuccagaacaagaagugggaccucuucguggagcgcagcaaggcccacuccaacugcuaccccuacgacgucccggacuacgcgagccugcggucccugguggccagcuccggcacgcucgaguucaacaacgagagcuucaacuggaccggggugacccagaacggcaccuccagcgccugcauccgccgguccaacaacagcuucuucucccgccugaacuggcugacgcaccucaacuucaaguaccccgcccugaacgucaccaugcccaacaacgagcaguucgacaagcuguacaucuggggcgugcaccaccccgggaccgacaaggaccagaucuuccucuacgcgcaggccagcgggcggaucaccguguccacgaagaagucccagcaggccgucaucccgaacaucggcagccgcccccgggugcgcaacauccccucccgggugagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgugaaccggaucacguacggggccugcccccgcuacgugaagcagaacacccugaagcuggcccccggcaugcggaacguccccgagaagcagacccgcgggaucuucggcgccaucgccggguucaucgagaacggcugggagggcaugguggacgggugguacggcuuccggcaccagaacagcgaggggcgcggccaggcggccgaccucaaguccacccaggccgccaucgaccagaucaacgggaagcugaaccggcugaucggcaagacgaucgagaaguuccaccagaucgagaacgaguucagcgagguggagggccgcauccaggaccucgagaaguacgucgaggacaccaagaucgaccugugguccuacaucgccgagcugcucguggcgcuggagaaccagcacaccaucgaccugaccgacagcgagaugaacaagcuguucgagaagacgaagaagcagcuccgggagaacgccgaggacauggggaacggcugcuucaagaucuaccacaagugcgacaacgccugcaucggguccauccgcaacggcaucuacgaccacgacguguaccgcgacgaggcccugaacaaccgguuccagaucaagggggucgagcucaagagcggcuacaaggacuggauccuguggaucuccuucgccaucagcugcuuccugcucugcguggcgcugcugggcuucaucaugugggccugccagaaggggaacauccgcugcaacaucugcaucuga

SEQ ID NO: 73486 - RNA, 1701 nt, Artificial Sequence
  derived and/or modified sequence opt1 from hemagglutinin__InfluenzaA__AID70460
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaucgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaucuacgaccacgacguguaccgcgacgaggcccucaacaaccgguuccagaucaaggggguggagcucaagagcggcuacaaggacuggauccuguggaucuccuucgccaucagcugcuuccugcugugcgucgcgcugcucggcuucaucaugugggccugccagaaggggaacauccgcugcaacaucugcaucuga

SEQ ID NO: 73487 - RNA, 1701 nt, Artificial Sequence
  derived and/or modified sequence opt1 from hemagglutinin__InfluenzaA__AID70461
augaagaccaucaucgcccugagcuacauccucugccugguguucgcccagaagcugcccggcaacgacaacuccaccgcgacccucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgucaaccggaucacguacggggcgugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggccgcggaccugaaguccacgcaggccgccaucgaccagaucaacgggaagcugaaccggcucaucggcaagaccaucgagaaguuccaccagaucgagaaggaguucagcgagguggagggccgcauccaggaccuggagaaguacaucgaggacaccaagaucgaccugugguccuacaacgccgagcuccugguggcccuggagaaccagcacaccaucgaccucacggacagcgagaugaacaagcuguucgagaagaccaagaagcagcugcgggagaacgcggaggacauggggaacggcugcuucaagaucuaccacaagugcgacaacgccugcaucggguccauccgcaacggcaucuacgaccacgacgucuaccgcgacgaggcccucaacaaccgguuccagaucaaggggguggagcucaagagcggcuacaaggacuggauccuguggaucuccuucgccaucagcugcuuccugcugugcguggcccugcucggcuucaucaugugggcgugccagaaggggaacauccgcugcaucacgugcaucuga

SEQ ID NO: 73488 - RNA, 1701 nt, Artificial Sequence
  derived and/or modified sequence opt1 from hemagglutinin__InfluenzaA__AID70463
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcaacagcccccaccagauccuggacggcgagaacugcacccucaucgacgcccugcugggggacccccagugcgacggcuuccagaacaagaagugggaccucuucguggagcgcagcaaggcccacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcuggccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccucaaguccacgcaggccgccaucgaccagaucaacgggaagcugaaccggcugaucggcaagaccaucgagaaguuccaccagaucgagaaggaguucagcgagguggagggccgcauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgggagaacgccgaggacauggggaacggcugcuucaagaucuaccacaagugcgacaacgccugcaucggguccauccgcaacggcaucuacgaccacgacguguaccgcgacgaggcccugaacaaccgguuccagaucaaggggguggagcucaagagcggcuacaaggacuggauccuguggaucuccuucgccaucagcugcuuccugcucugcgucgcgcugcugggcuucaucaugugggccugccagaaggggaacauccgcugcaacaucugcaucuga

SEQ ID NO: 73489 - RNA, 1701 nt, Artificial Sequence
  derived and/or modified sequence opt1 from hemagglutinin__InfluenzaA__AID70464
augaagaccaucaucgcccugagcuacauccucugccugguguucgcccagaagcugcccggcgacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaucgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcucaagagcggcuacaaggacuggauccuguggaucuccuucgccaucagcugcuuccugcugugcgucgcgcugcucggcuucaucaugugggccugccagaaggggaacauccgcugcaacaucugcaucuga

SEQ ID NO: 73490 - RNA, 1701 nt, Artificial Sequence
  derived and/or modified sequence opt1 from hemagglutinin__InfluenzaA__AID70465
augaagaccaucaucgcccugagcuacauccucugccugguguucgcccagaagcugcccggcgacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaucgagaaguuccaccagaucgagaaggaguucagcgagguggagggccgcauccaggaccuggagaaguacguggaggacaccaagaucgaccugugguccuacaacgccgagcuccuggucgcgcuggagaaccaccacgccaucgaccucaccgacagcgagaugaacaagcuguucgagaagacgaagaagcagaugcgggagaacgccgaggacauggggaacggcugcuucaagaucuaccugaagugcgacaacgccugcaucggguccauccgcaacggcaucuacgaccacgacguguaccgcgacgaggcccucaacaaccgguuccagaucaaggggguggagcucaagagcggcuacaaggacuggauccuguggaucuccuucaccgagagcugcuuccugcugugcgucgcgcugcucggcuucaucaugugggccugccagaaggggaacauccgcugcaacaucugcaucuga

SEQ ID NO: 73491 - RNA, 1701 nt, Artificial Sequence
  derived and/or modified sequence opt1 from hemagglutinin__InfluenzaA__AID70466
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaucgagaaguuccaccagaucgagaacgaguucagcgagguggagggccgcauccaggaccuggagaaguacguggaggacaccaagaucgaccugugguccuacaucggggagcuccuggucgcccuggagaaccagcacaccaucgaccucacggacagcgagaugaacaagcuguucgagaagaccaagaagcagcugcgggagaacgcggaggacaugggcaacgggugcuucaagaucuaccacaagugcgacaacgccugcaucggcuccauccgcaacgggaucuacgaccacgacguguaccgcgacgaggcccucaacaaccgguuccagaucaagggcguggagcucaagagcggcuacaaggacuggauccuguggaucuccuucgccaucagcugcuuccugcugugcgucgcccugcucggguucaucaugugggcgugccagaagggcaacauccgcugcaacaucugcaucuga

SEQ ID NO: 73492 - RNA, 1701 nt, Artificial Sequence
  derived and/or modified sequence opt1 from hemagglutinin__InfluenzaA__AID70467
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacugcgaggggcgcggccaggcggccgaccucaagagcacgcaggccgccaucgaccagaucaacgggaagcugaaccggcucaucggcaagaccaucgagaaguuccaccagaucgagaacgaguucuccgagguggagggccgcauccaggggcuggagaaguacguggaggacaccaagaucgaccuguggagcuacaucgccgagcucaucgucgcgcuggagaaccagcacaccaucgaccugacggacuccgagaugaacaagcuguucgagaagaccaagaagcagaugcgggagaacgccgaggacaugggcaacgggugcuucaagaucuaccacaagugcgacaacgccugcaucggcagcauccgcaacgggaucuacgaccacgacguguaccgcgacgaggcccugaacaaccgguuccagaucaagggcguggagcugaaguccggcuacaaggacuggauccucuggaucagcuucgccaucuccugcuuccugcugugcgucgcgcuccugggguucaucaugugggccugccagaagggcaacauccgcugcaacaucugcaucuga

SEQ ID NO: 73493 - RNA, 1701 nt, Artificial Sequence
  derived and/or modified sequence opt1 from hemagglutinin__InfluenzaA__AID70468
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcuccaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacugcgaggggcggggccaggcggccgaccucaagagcacgcaggccgccaucgaccagaucaacgggaagcugaaccgccucaugggcaaguccaucgagaaguuccaccagaucgagaacgaguucagcgagguggagggccggauccaggggcuggagaaguacguggaggacaccaagaucgaccugugguccuacaacggcgagcucaucgucgcccuggagaaccagcacgcgaucgaccugaccgacagcgagaugaacaagcuguucgagaagaccaagaagcagaugcgcgagaacgccgaggacauggggaacggcugcuucaagaucuaccugaagugcgacaacgccugcaucggguccauccgcaacggcaucuacgaccacgacguguaccgggacgaggcccugaacaaccgcuuccagaucaagggcguggagcucaagagcggguacaaggacuggauccuguggaucuccuucacgaucagcugcuuccugcucugcgucgcccugcugggcuucaucaugugggcgcggcagaaggggaacauccgcugcaacaucugcaucuga

SEQ ID NO: 73494 - RNA, 1701 nt, Artificial Sequence
  derived and/or modified sequence opt1 from hemagglutinin__InfluenzaA__AID70469
augaagaccaucaucgcccugagcuacauccucugccugguguucgcccagaagguccccggcaacgagaacuccaccgcgacgcugugccucgggcaccacgccgugccgaacggcaccaucgugaagaccaucaccaacgaccagaucgaggucacgaacgccaccgagcuggugcagagcuccagcaccggggagaucugcaacagcccccaccagauccuggacggcgagaacugcacccucaucgacgcccugcugggggacccccagugcgacggcuuccagaacaagaagugggaccucuucguggagcgcuccaaggcccacuccaacugcuaccccuacgacgucccggacuacgcgagccugcggucccugguggccagcuccggcacgcucgaguucaacaacgagagcuucaacuggaccggggugacccagaacggcaccuccagcgccugcauccgccgguccaacaacagcuucuucucccgccugaacuggcugacgcaccucaacuucaaguaccccgcccugaacgucaccaugcccaacaacgagcaguucgacaagcuguacaucuggggcgugcaccaccccgggaccgacaaggaccagaucuuccucuacgcgcaggccagcgggcggaucaccguguccacgaagcgcagccagcaggccgucaucccgaacaucggcagccggccccgcgugcggaacauccccucccgcgugagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaacagcgcgugcaucacccccaacggcuccauccccaacgacaagccguuccagaacgugaaccgcaucacguacggggccugcccccgguacgugaagcagaacacccugaagcuggccaccggcaugcgcaacguccccgagaagcagacccgggggaucuucggcgccaucgccggguucaucgagaacggcugggagggcaugguggacgggugguacggcuuccgccaccagaacugcgaggggcggggccaggcggccgaccucaagagcacgcaggccgccaucgaccagaucaacgggaagcugaaccgccugaucggcaagaccaucgagaaguuccaccagaucgagaaggaguucuccgagguggagggccggauccaggggcucgagaaguacgucgaggacaccaagaucgaccuguggagcuacaacgccgagcugcucguggcgcuggagaaccagcacaccaucgaccugacggacuccgagaugaacaagcuguucgagaagaccaagaagcagaugcgcgagaacgccgaggacaugggcaacgggugcuucaagaucuaccacaagugcgacaacgccugcaucggcagcauccgcaacgggaucuacgaccacgacguguaccgggacgaggcccucaacaaccgcuuccagaucaagggcgucgagcugaaguccggcuacaaggacuggauccucuggaucagcuucaccaucuccugcuuccugcugugcguggcccuccugggguucaucaugugggcgugccagaagggcaacauccggugcaacaucugcaucuga

SEQ ID NO: 73495 - RNA, 1701 nt, Artificial Sequence
  derived and/or modified sequence opt1 from hemagglutinin__InfluenzaA__AID70470
augaagaccaucaucgcccugagcuacauccucugccugguguucgcccagaagguccccggcaacgagaacuccaccgcgacgcugugccucgggcaccacgccgugccgaacggcaccaucgugaagaccaucaccaacgaccagaucgaggucacgaacgccaccgagcuggugcagagcuccagcaccggggagaucugcaacagcccccaccagauccuggacggcgagaacugcacccucaucgacgcccugcugggggacccccagugcgacggcuuccagaacaagaagugggaccucuucguggagcgcuccaaggcccacuccaacugcuaccccuacgacgucccggacuacgcgagccugcggucccugguggccagcuccggcacgcucgaguucaacaacgagagcuucaacuggaccggggugacccagaacggcaccuccagcgccugcauccgccgguccaacaacagcuucuucucccgccugaacuggcugacgcaccucaacuucaaguaccccgcccugaacgucaccaugcccaacaacgagcaguucgacaagcuguacaucuggggcgugcaccaccccgggaccgacaaggaccagaucuuccucuacgcgcaggccagcgggcggaucaccguguccacgaagcgcagccagcaggccgucaucccgaacaucggcagccggccccgcgugcggaacauccccucccgcgugagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaacagcgcgugcaucacccccaacggcuccauccccaacgacaagccguuccagaacgugaaccgcaucacguacggggccugcccccgguacgugaagcagaacacccugaagcuggccaccggcaugcgcaacguccccgagaagcagacccgggggaucuucggcgccaucgccggguucaucgagaacggcugggagggcaugguggacgggugguacggcuuccgccaccagaacugcgaggggcggggccaggcggccgaccucaagagcacgcaggccgccaucgaccagaucaacgggaagcugaaccgccugaucggcaagaccaucgagaaguuccaccagaucgagaaggaguucuccgagguggagggccggauccaggggcucgagaaguacgucgaggacaccaagaucgaccuguggagcuacaacggcgagcugcucguggcccuggagaaccaccacaccaucgaccugacggacuccgagaugaacaagcuguucgagaagaccaagaagcagaugcgcgagaacgcggaggacauggggaacggcugcuucaagaucuaccacaagugcgacaacgccugcaucgggagcauccgcaacggcaucuacgaccacgacguguaccgggacgaggcccucaacaaccgcuuccagaucaagggcgucgagcugaaguccggguacaaggacuggauccucuggaucagcuucaccaucuccugcuuccugcugugcguggcccuccugggcuucaucaugugggccugccagaaggggaacauccggugcaacaucugcaucuga

SEQ ID NO: 73496 - RNA, 1701 nt, Artificial Sequence
  derived and/or modified sequence opt1 from hemagglutinin__InfluenzaA__AID70471
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcaacagcccccaccagauccucgacggcgagaacugcacgcugaucgacgcccugcucggggacccccagugcgacggcuuccagaacaagaagugggaccuguucguggagcgcagcaaggcccacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcgagcgggcggaucacgguguccaccaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgccugcaucacgcccaacggcuccauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacagcgaggggcgcggccaggccgcggaccugaaguccacccaggccgccaucgaccagaucaacgggaagcugaaccggcucaucggcaagaccaucgagaaguuccaccagaucgagaacgaguucagcgagguggagggccgcauccaggaccuggagaaguacguggaggacaccaagaucgaccugugguccuacaacgccgagcucaucgucgcccuggagaaccaccacacgaucgaccugaccgacagcgagaugaacaagcuguucgagaagaccaagaagcagaugcgggagaacgcggaggacauggggaacggcugcuucaagaucuaccacaagugcgacaacgccugcaucggguccauccgcaacggcaucuacgaccacgacguguaccgcgacgaggcccugaacaaccgguuccagaucaaggggguggagcucaagagcggcuacaaggacuggauccucuggaucuccuucgccaucagcugcuuccugaucugcgucgcccugcucggcuucaucaugugggcgugccagaaggggaaccugcgcugcaacaucugcaucuga

SEQ ID NO: 73497 - RNA, 1701 nt, Artificial Sequence
  derived and/or modified sequence opt1 from hemagglutinin__InfluenzaA__AID70472
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaucgagaaguuccaccagaucgagaaggaguucagcgagguggagggccgcauccaggaccuggagaaguacguggaggacaccaagaucgaccugugguccuacaacgccgagcuccuggucgcgcuggagaaccaccacaccaucgaccucacggacagcgagaugaacaagcuguucgagaagaccaagaagcagaugcgggagaacgccgaggacauggggaacggcugcuucaagaucuaccacaagugcgacaacgccugcaucggguccauccgcaacggcaucuacgaccacgacguguaccgcgacgaggcccugaacaaccgguuccagaucaaggggguggagcucaagagcggcuacaaggacuggauccuguggaucuccuucgccaucagcugcuuccugcucugcgucgcgcugcugggcuucaucaugugggccugccagaaggggaacauccgcugcaacaucugcaucuga

SEQ ID NO: 73498 - RNA, 1701 nt, Artificial Sequence
  derived and/or modified sequence opt1 from hemagglutinin__InfluenzaA__AID70473
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacugcgaggggcgcggccaggcggccgaccucaagagcacgcaggccgccaucgaccagaucaacgggaagcugaaccggcugaucggcaagaccaucgagaaguuccaccagaucgagaaggaguucuccgagguggagggccgcauccaggggcuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagaugcgggagaacgccgaggacaugggcaacgggugcuucaagaucuaccacaagugcgacaacgccugcaucggcagcauccgcaacgggaucuacgaccacgacguguaccgcgacgaggcccugaacaaccgguuccagaucaagggcguggagcucaaguccggcuacaaggacuggauccuguggaucagcuucgccaucuccugcuuccugcucugcgucgcgcugcugggguucaucaugugggccugccagaagggcaacauccgcugcaacaucugcaucuga

SEQ ID NO: 73499 - RNA, 1701 nt, Artificial Sequence
  derived and/or modified sequence opt1 from hemagglutinin__InfluenzaA__AID70474
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacgucugggagggcaugguggacggcugguucggguuccggcaccagaucugcgagggccgcgggcaggcggccggccuggagagcacgcaggccgccaucgaccagaucaacgggaagaugaaccggcugaugggcaagaccaucggcaaguuccaccagaucgugaacgaguucuccgaggucgaggggcgcauccaggaccucgagaaguacguggaggacaccaagaucgaccuguggagcuacaucggcgagcugcucguggcccuggagaaccaccacgcgaucgaccugaccgacuccgagaugaacaagcuguucgagaagacgaagaagcagaugcgggagaacgccgaggacauggggaacggcugcuucaagaucuaccacaagugcgacaacgccugcaucgggagcauccgcaacggcaucuacgaccgcgacgucuaccgggacgaggcccucaacaaccgcuuccacaucaagggcguggagcugaaguccggguacaaggacuggaucaucuggaucagcuccaccgagagcugcuuccuccugugcgucgcccugcucggcuucaucaugugggcgugccagaaggggaacauccgguccaacaucugcaucuga

SEQ ID NO: 73500 - RNA, 1701 nt, Artificial Sequence
  derived and/or modified sequence opt1 from hemagglutinin__InfluenzaA__AID70475
augaagaccaucaucgcccugagcuacaugcucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacgucugggagggcaugguggacggcugguacggguuccggcaccagaacugcgagggccgcgggcaggcggccgaccucaagagcgcccaggccgccaucgaccccaucaacggcaagcugaaccggcugauggggaagacgaucggcaaguuccaccagaucgagaaggaguucuccgagguggagggccgcauccaggaccuggagaaguacgucgaggacaccaagaucgaccuguggagcuacaacggggagcuccugguggcgcuggagaaccagcacgccaucgaccucaccgacuccgagaugaacaagguguucgagaagaccaagaagcagcugcgggagaacgccgaggacaugggcaacgggugcuucaagaucuaccacaagugcgacaacgccugcaucggcagcauccgcaacgggaucuacgaccacgacgucuaccgcaacgaggcccugaacaaccgguuccagaucaagggcguggagcucaaguccggcuacaaggacuggauccuguggaucagcuucgcgaucuccugcuuccugcucagcgucgccucccugggguucaucaugugggccuaccagaagggcaacauccgcugcaacaucugcaucuga

SEQ ID NO: 73501 - RNA, 1701 nt, Artificial Sequence
  derived and/or modified sequence opt1 from hemagglutinin__InfluenzaA__AID70476
augaagaccaucaucgcccugagcuacauccucugccugguguucgcccagaagcugcccggcaacgagaacuccaccgcgacgcucgggcugggccaccacgccgucccgaacgggaccaucgugaagaccaucaccaacgaccagaucgaggugacgaacgccaccgagcugguccagagcuccagcaccggcgagaucugcaacagcccccaccagauccucgacggggagaacugcacccugaucgacgcccugcucggcgacccccagugcgacgacuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacaaccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacccaggccgccaucgaccagaucaacgggaagcugaaccggcucaucggcaagacgaucgagaaguuccaccagaucgagaaggaguucagcgagguggagggccgcauccaggggcgggagaaguacguggaggacaccaagaucgaccugugguccuacaucggcgaguucaucgucgcccuggagaaccagcacaccaucgaccucaccgacagcgagaugaacaagcuguucgagaagacgaagaagcagaugcgcgagaacgcggaggacauggggaacggcugcuucaagaucuaccacaagugcgacaacgccugcaucggguccauccgcaacggcaucuacgaccacgacguguaccgggacgaggcccugaacaaccgcuuccagaucaagggcguggagcucaagagcggguacaaggacuggauccuguggaucuccuucgccaucagcugcuuccugcucugcgucgcccugcugggcuucaucaugugggcgugccagaaggggaacauccggugcaacaucugcaucuga

SEQ ID NO: 73502 - RNA, 1701 nt, Artificial Sequence
  derived and/or modified sequence opt1 from hemagglutinin__InfluenzaA__AID70477
augaagaccaucaucgcccugagcuacauccucugccugguguucgcccagaagcugcccggcaacgacuccagcaccgggacgcucugccugggccaccacgcggucccgaacgggaccaucgugaagaccaucaccaacgaccagaucgaggugacgaacgccaccgagcugguccaguccagcuccaccggcgagaucugcaaccgcccccaccagauccucgacggggagaacugcacccugaucgacgcccugcucggcgacccccagugcgacggcuuccagaacaagaagugggaccuguucguggagcggagcaaggcccacuccaacugcuaccccuacgacgugccggacuacgccagccugcgcucccucgucgcgagcuccgggacgcuggaguucaacaacgagagcuucaacuggaccggcgugacccagaacgggaccuccagcgccugcauccggcgcuccaacaacagcuucuucuccauccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccaggcgagcggccggaucaccguguccacgaagaagucccagcaggccgugaucccgaacaucggcagccgcccccggguccgcaacauccccagccgggugagcaucuacuggaccaucgugaagcccggggagauccugcucaucaacuccaccggcaaccugaucgccccgcgcggguacuucaagauccggagcggcaaguccagcaucaugcgcuccgacgcccccaucggcaagugcuacagcgccugcaucacccccaacggguccauccccaacgacaagccguuccagaacgucaaccggaucacguacggcgcgugcccccgcuacgugaagcagcacccccugaagcucgccaccgggaugcggaacgugcccgagaagcagacccgcggcaucuucggggccaucgccggcuucaucgagaacggcugggaggggauggucgacggcugguacggguuccggcaccagaucugcgagggccgcgggcaggccgcggaccucaagagcacccaggccgccaucgaccagaucaacggcaagcugaaccggcucaucggcaagacgaucgagaaguuccaccagaucgagaaggaguucuccgagguggaguggcgcauccaggggcuggagaaguacguggaggacaccaaggucgaccuguggagcuacaacggcgagcucaucguggcccuggagaaccaccacaccaucgaccugaccgacuccgagaugaacaagcuguucgagaagacgaagaagcagaugcgggagaacgccgaggacauggggaacggcugcuucaagaucuaccugaagugcgacaacgcgugcaucgggagcauccgcaacggcaucuacgaccacgacguguaccgcgacgaggcccugaacaaccgguuccagaucaagggcgucgagcucaaguccggguacaaggacuggauccuguggaucagcuucaccgaguccugcuuccugcucagcguggcccugcugggcuucaucaugugggccugccagaaggggaacauccgcugcaacaucugcaucuga

SEQ ID NO: 73503 - RNA, 1701 nt, Artificial Sequence
  derived and/or modified sequence opt1 from hemagglutinin__InfluenzaA__AID70478
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacugcgaggggcgcggccaggcggccgaccuggagagcacgcaggccgccaucgaccagaucaacgggaagaugaaccggcugaugggcaagaccaucgagaaguuccaccagaucgagaaggaguucuccgagguggagggccgcauccaggggcgggagaaguacguggaggacaccaagaucgaccucuggagcuacaacggcgagcugcuggucgaccucgagaaccagcacaccaucgaccugacggacuccgagaugaacaagguguucgagaagaccaagaagcagaugcgcgagaacgccgaggacauggggaacggcugcuucaagaucuaccacaagugcgacaacgcgugcaucgggagcauccgcaacggcaucuacgaccacgacguguaccgggacgaggcccugaacaaccgcuuccagaucaagggcgucgagcucaaguccggguacaaggacuggauccaguggaucagcuucaccaucuccugcuuccugcugugcgugagccuccugggcuucaucaugugggccugccagaaggggaacauccggugcaacaucugcaucuga

SEQ ID NO: 73504 - RNA, 1701 nt, Artificial Sequence; identical to SEQ ID NO: 71048
  derived and/or modified sequence opt1 from hemagglutinin__InfluenzaA__AID70632

SEQ ID NO: 73505 - RNA, 1683 nt, Artificial Sequence
  derived and/or modified sequence opt1 from hemagglutinin__InfluenzaA__AID70634
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucaccuucagcuucaacggcgcguucaucgcccccgaccgcgccuccuuccuccggggcaagagcauggggauccaguccggcguccagguggacgccaacugcgagggggacugcuaccacagcggcgggacgaucaucuccaaccugcccuuccagaacaucgacagccgcgccgugggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggaucaucgagaagaccaaccagcaguucgagcugaucgacaacgaguucaacgaggucgagaagcagaucagcaacgugaucaacuggacccgcgacuccaucaccgagguguggagcuacaacgccgagcuccuggucgccauggagaaccagcacacgaucgaccuggccgacuccgagauggacaagcucuacgagcgcgugaagcggcagcugcgcgagaacgcggaggaggacgggaccggcugcuucgagaucuuccacaagugcgacgacgacugcauggccagcauccggaacaacaccuacgaccacuccaaguaccgcgaggaggccaugcagaaccggauccagaucgaccccgucaagcugagcuccggcuacaaggacgugauccucugguucagcuucggggccuccugcuucauccugcuggcgaucgugaugggccucgucuucaucugcgugaagaacgggaacaugcgcugcaccaucugcaucuga

SEQ ID NO: 73506 - RNA, 1701 nt, Artificial Sequence
  derived and/or modified sequence opt1 from hemagglutinin__InfluenzaA__AIF72902
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgaggucgagggccgcauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcgcugcucggcuucaucaugugggccugccagaaggggaacauccgcugcaacaucugcaucuga

SEQ ID NO: 73507 - RNA, 1701 nt, Artificial Sequence
  derived and/or modified sequence opt1 from hemagglutinin__InfluenzaA__AIF72903
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgaggucgagggccgcauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacgucuaccgcgacgaggcccucaacaaccgguuccagaucaaggggguggagcugaaguccggcuacaaggacugggugcuguggaucagcuucgccaucuccugcuuccuccugugcgucgcgcugcucggcuucaucaugugggccugccagaaggggaacauccgcugcaacaucugcaucuga

SEQ ID NO: 73508 - RNA, 1701 nt, Artificial Sequence
  derived and/or modified sequence opt1 from hemagglutinin__InfluenzaA__AIF72904
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacguguaccgcgacgaggcccucaacaaccgguuccagaucaagggggucgagcugaaguccggcuacaaggacugggugcuguggaucagcuucgccaucuccugcuuccuccugugcguggcgcugcucggcuucaucaugugggccugccagaaggggaacauccgcugcaacaucugcaucuga

SEQ ID NO: 73509 - RNA, 1701 nt, Artificial Sequence
  derived and/or modified sequence opt1 from hemagglutinin__InfluenzaA__AIF72905
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaagaacgagagcuucaacuggacgggggugacccagaacggcaccuccagcgccugcauccggcgcuccaacaacagcuucuucucccggcugaacuggcucacccacagcaacuucaaguaccccgcgcugaacgugacgaugcccaacaacgagcaguucgacaagcuguacaucuggggcguccaccaccccgggaccgacaaggaccagaucuuccucuacgcccaggccuccgggcgcaucaccgugagcaccaagcggagccagcaggccgugaucccgaacaucggcucccgcccccggguccgcaacauccccagccggaucuccaucuacuggacgaucgugaagcccggcgacauccugcugaucaacagcaccgggaaccucaucgccccgcgcggcuacuucaagauccgguccgggaaguccuccaucaugcgcagcgacgcgcccaucggcaagugcaacuccgagugcaucacccccaacggcagcauccccaacgacaagccguuccagaacgugaaccggaucaccuacggggccugcccccgcuacgucaagcaguccacgcugaagcuggccaccggcaugcggaacgugcccgagaagcagacccgcgggaucuucggcgccaucgccggguucaucgagaacggcugggagggcaugauggacgggugguacggcuuccggcaccagaacagcgaggggcgcggccaggcggccgaccucaaguccacccaggccgccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcgcuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgccugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcucugcguggcgcugcugggcuucaucaugugggccugccagaaggggaacauccgcugcaacaucugcaucuga

SEQ ID NO: 73510 - RNA, 1701 nt, Artificial Sequence; identical to SEQ ID NO: 64419
  derived and/or modified sequence opt1 from hemagglutinin__InfluenzaA__AIF72906

SEQ ID NO: 73511 - RNA, 1701 nt, Artificial Sequence; identical to SEQ ID NO: 64419
  derived and/or modified sequence opt1 from hemagglutinin__InfluenzaA__AIF72907

SEQ ID NO: 73512 - RNA, 1701 nt, Artificial Sequence; identical to SEQ ID NO: 64419
  derived and/or modified sequence opt1 from hemagglutinin__InfluenzaA__AIF72908

SEQ ID NO: 73513 - RNA, 1701 nt, Artificial Sequence
  derived and/or modified sequence opt1 from hemagglutinin__InfluenzaA__AIF72909
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacggcccccaccagauccucgacggggagaacugcacccugaucgacgcccugcucggcgacccccagugcgacggcuuccagaacaagaagugggaccuguucguggagcgcucccgggcguacagcaacugcuaccccuacgacgugccggacuacgccucccugcgcagccucgucgccuccagcgggacccuggaguucaacaacgaguccuucaacuggacgggcaccacccagaacgggaccagcuccgccugcauccggcgcagcaacaacuccuucuucagccggcugaacuggcucacgcaccugaacuucaaguaccccgcgcugaacgugaccaugcccaacaacgagcaguucgacaagcucuacaucuggggcgugcaccaccccgggaccgacaaggaccagaucuuccuguacgcccaggccuccggccgcaucaccgucagcacgaagcggucccagcaggccgugaucccgaacaucggcagccgcccccgggugcgcaacauccccagccggaucuccaucuacuggaccaucgucaagcccggggacauccugcucaucaacagcaccggcaaccugaucgccccgcgcggguacuucaagauccgguccggcaagagcuccaucaugcgcagcgacgcgcccaucggcaagugcaacuccgagugcaucacccccaacgggagcauccccaacgacaagccguuccagaacgugaaccggaucacguacggcgccugcccccgcuacgugaagcaguccacccugaagcucgccaccgggaugcggaacguccccgagaagcagacccgcggcaucuucggggccaucgccggcuucaucgagaacggcugggaggggaugguggacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacaugggcaacgggugcuucaagaucuaccacaagugcgacaacgccugcaucggcuccauccggaacgggaccuacgaccacgacguguaccgcgacgaggcccucaacaaccgguuccagaucaagggcgucgagcucaagagcggcuacaaggacuggauccuguggaucuccuucgccaucagcugcuuccugcugugcguggcgcugcucggguucaucaugugggccugccagaagggcaacauccgcugcaacaucugcaucuga

SEQ ID NO: 73514 - RNA, 1701 nt, Artificial Sequence; identical to SEQ ID NO: 64419
  derived and/or modified sequence opt1 from hemagglutinin__InfluenzaA__AIF72910

SEQ ID NO: 73515 - RNA, 1701 nt, Artificial Sequence; identical to SEQ ID NO: 64419
  derived and/or modified sequence opt1 from hemagglutinin__InfluenzaA__AIF72911

SEQ ID NO: 73516 - RNA, 1701 nt, Artificial Sequence; identical to SEQ ID NO: 73506
  derived and/or modified sequence opt1 from hemagglutinin__InfluenzaA__AIF72912

SEQ ID NO: 73517 - RNA, 1701 nt, Artificial Sequence; identical to SEQ ID NO: 64419
  derived and/or modified sequence opt1 from hemagglutinin__InfluenzaA__AIF72913

SEQ ID NO: 73518 - RNA, 1701 nt, Artificial Sequence
  derived and/or modified sequence opt1 from hemagglutinin__InfluenzaA__AIF72914
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcgggggcaagagcuccaucaugcggagcgacgcccccaucggcaagugcaacuccgagugcaucacccccaacgggagcauccccaacgacaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacuccgagggccgggggcaggccgcggaccugaaguccacgcaggccgccaucgaccagaucaacggcaagcugaaccgccucaucggcaagaccaacgagaaguuccaccagaucgagaaggaguucuccgaggucgaggggcggauccacgaccuggagaaguacguggaggacacccuguucgaccucuggguguacaacagcgagcugcuggucgcccuccagaaccagcacaccaucgaccugcccgacuccgagaugaacaagcuguucgagaagacgaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcguggagcugaaguccggcuacaaggacuggauccucuggaucagcuucgccaucuccugcuuccugcugugcgucgcccuccugggguucaucaugugggccugccagaagggcaacauccggugcaacaucugcaucuga

SEQ ID NO: 73519 - RNA, 1701 nt, Artificial Sequence
  derived and/or modified sequence opt1 from hemagglutinin__InfluenzaA__AIF72915
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccuccagauccuggacggcgagaacugcacccugaucgacgcccuccugggggacccccagugcgacggcuuccagaacaagaagugggaccuguucguggagcgcagcaaggccuacuccaacugcuaccccuacgacgugccggacuacgcgagccuccggucccuggucgccagcuccggcacgcuggaguucaacaacgagagcuucaacuggaccggggugacccagaacggcaccuccagcgccugcauccgccgguccaacaacagcuucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccuccugaucaacuccaccgggaaccugaucgccccgcggggcuacuucaagauccgcagcgggaaguccagcaucaugcgguccaacgcccccaucggcaagugcaacagcgagugcaucacccccaacggcuccauccccaacgacaagccguuccagaacgugaaccgcaucacguacggggcgugcccccgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacaccaucgaccugacggacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucuccuucgccaucagcugcuuccugcugugcguggcccuccugggcuucaucaugugggcgugccagaaggggaacauccggugcaacaucugcaucuga

SEQ ID NO: 73520 - RNA, 1701 nt, Artificial Sequence; identical to SEQ ID NO: 64419
  derived and/or modified sequence opt1 from hemagglutinin__InfluenzaA__AIF72916

SEQ ID NO: 73521 - RNA, 1701 nt, Artificial Sequence
  derived and/or modified sequence opt1 from hemagglutinin__InfluenzaA__AIF72917
augaagaccaucaucgcccugagcuacauccucugccugguguucgcccagaagcugccccgcaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacggggagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacgcuggaguucaagaacgagagcuucaacuggaccggcgugacccagaacgggaccuccagcgccugcauccggcgcuccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgugaucccgaacaucgggagccgcccccggguccgcaacauccccucccggaucagcaucuacuggaccaucgugaagcccggcgacauccugcucaucaacuccaccggcaaccugaucgccccgcgcggguacuucaagauccggagcggcaaguccagcaucaugcgcuccgacgcccccaucgggaagugcaacagcgagugcaucacccccaacggcuccauccccaacgacaagccguuccagaacgugaaccggaucacguacggcgcgugcccccgcuacgucaagcagaacacccugaagcucgccaccgggaugcggaacgugcccgagaagcagacccgcggcaucuucggggccaucgccggcuucaucgagaacgggugggagggcaugguggacggcugguacggguuccggcaccagaacagcgagggccgcgggcaggccgcggaccugaaguccacgcaggccgccaucgaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucuccuucgccaucagcugcuuccuccugugcguggcccugcucggcuucaucaugugggcgugccagaagggcaacauccgcugcgacaucugcaucuga

SEQ ID NO: 73522 - RNA, 1683 nt, Artificial Sequence
  derived and/or modified sequence opt1 from hemagglutinin__InfluenzaA__AIG44693
auggagaccgccagccugaucaccauccuccugguggucacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugcugcucgggggccgcgaguggagcuacaucguggagcggcccuccgccgucaacggccugugcuaccccgggaacguggagaaccuggaggagcuccgcagccuguucuccagcgcccgguccuaccagcgcauccagaucuucccggacaccaucuggaacgugagcuacuccggcaccagcaaggccugcuccgacagcuucuaccgguccaugcgcuggcugacccagaaggacaacgcguaccccauccaggacgcccaguacaccaacaaccaggagaagaacauccucuucaugugggggaucaaccacccgcccaccgacacggcccagaccaaccuguacacccggaccgacacgaccaccagcgucgccaccgaggagaucaaccgcacguucaagccccugaucggcccccggccccucgugcacgggcugaugggccgcaucaacuacuacugguccgugcugaagcccggccagacccuccggaucaagagcaacgggaaccugaucgcgccgugguacggccacauccugagcgggaagucccacggccgcauccucaagaccgaccugaagcggggcaacugcaccguccagugccagacggagaagggcgggcugaacaccacccuccccuuccagaacgugagcaaguacgccuucgggaacugcuccaaguacaucggcaucaagagccugaagcuggccguggggcuccgcaacguccccucccggagcucccgcggccuguucggcgccaucgccggguucaucgagggcggguggagcggccugguggcggggugguacggcuuccagcacuccaacgaccagggcguggggauggccgccgaccgggacagcacccagaaggccaucgacaagaucacguccaaggucaacaacaucguggacaagaugaacaagcaguacgagaucaucgaccacgaguucagcgagguggagacccgccucaacaugaucaacaacaagaucgacgaccagauccaggacaucugggccuacaacgcggagcugcugguccuccuggagaaccagaagacccuggacgagcacgacgccaacgugaacaaccucuacaacaaggugaagcgggcccugggcuccaacgccgucgaggacgggaagggcugcuucgagcuguaccacaagugcgacgaccagugcauggagaccauccgcaacgggacguacaaccggcgcaaguaccaggaggagagcaagcucgagaagcagaagaucgagggcgugaagcuggaguccgagggcaccuacaagauccugaccaucuacagcaccgucgccuccagccucgugaucgcgaugggguucgccgccuuccuguucugggccauguccaacggcagcugccgcugcaacaucugcaucuga

SEQ ID NO: 73523 - RNA, 1701 nt, Artificial Sequence; identical to SEQ ID NO: 67990
  derived and/or modified sequence opt1 from hemagglutinin__InfluenzaA__AIJ10728

SEQ ID NO: 73524 - RNA, 1701 nt, Artificial Sequence
  derived and/or modified sequence opt1 from hemagglutinin__InfluenzaA__AIJ10729
augaagaccaucaucgcccugagcuacauccucugccugguguucgcccagaagcugcccggccacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagaccaaggggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 73525 - RNA, 1701 nt, Artificial Sequence; identical to SEQ ID NO: 67990
  derived and/or modified sequence opt1 from hemagglutinin__InfluenzaA__AIJ10730

SEQ ID NO: 73526 - RNA, 1701 nt, Artificial Sequence; identical to SEQ ID NO: 67990
  derived and/or modified sequence opt1 from hemagglutinin__InfluenzaA__AIJ10731

SEQ ID NO: 73527 - RNA, 1701 nt, Artificial Sequence
  derived and/or modified sequence opt1 from hemagglutinin__InfluenzaA__AIJ10732
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuuccgguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggagccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 73528 - RNA, 1701 nt, Artificial Sequence
  derived and/or modified sequence opt1 from hemagglutinin__InfluenzaA__AIJ10733
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuuccgguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggagccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaagagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 73529 - RNA, 1701 nt, Artificial Sequence
  derived and/or modified sequence opt1 from hemagglutinin__InfluenzaA__AIJ10734
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcaacagcccccaccagauccucgacggggagaacugcacccugaucgacgcccugcucggcgacccccagugcgacggguuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggcgugacccagaacgggaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcagccagcaggccgugaucccgaacaucgggagccggccccgcguccggaacauccccucccgcaucagcaucuacuggaccaucgugaagcccggcgacauccugcucaucaacuccaccggcaaccugaucgccccgcggggguacuucaagauccgcagcggcaaguccagcaucaugcgguccgacgcccccaucgggaagugcaacagcacgugcaucacccccaacggcuccauccccaacgacaagccguuccagaacgugaaccgcaucaccuacggcgcgugcccccgguacgucaagcagaacacccugaagcucgccaccgggaugcgcaacgugcccgagaagcagacgcggggcaucuucggggccaucgccggcuucaucgagaacgggugggagggcaugguggacggcugguacggguuccgccaccagaacagcgagggccgggggcaggccgcggaccugaaguccacccaggccgccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggcgugccagaagggcaacauccggugcaacaucugcaucuga

SEQ ID NO: 73530 - RNA, 1701 nt, Artificial Sequence
  derived and/or modified sequence opt1 from hemagglutinin__InfluenzaA__AIJ10735
augaagaccaucaucgcccugagcuacauccucugccugaucuucgcccagaagcugcccgagaacgacaacuccaccgcgacgcucugccugggccaccacgccgugccgaacgggaccaucgucaagaccaucaccaacgaccagaucgaggugacgaacgccaccgagcuggugcagagcuccagcaccggcgagaucugcaacagcccccaccagauccucgacggggagaacugcacccugaucgacgcccugcucggcgacccccagugcgacggguuccagaacaagaagugggaccuguucgucgagcgcagcaaggcccacuccaacugcuaccccuacgacgugccggacuacgcgagccugcggucccucguggccagcuccggcacgcuggaguucaacaacgagagcuucaacuggaccggcgucacccagaacgggaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccagcggccggaucaccgucuccacgaagcgcagccagcaggccgugaucccgaacaucgggagccggccccgcgugcggaacauccccucccgcgucagcaucuacuggaccaucgugaagcccggcgacauccugcucaucaacuccaccggcaaccugaucgccccgcggggguacuucaagauccgcagcggcaaguccagcaucaugcgguccgacgcccccaucgggaagugcaacagcacgugcaucacccccaacggcuccauccccaacgacaagccguuccagaacgugaaccgcaucaccuacggcgcgugcccccgguacgucaagcagaacacccugaagcucgccaccgggaugcgcaacgugcccgagaagcagacgcggggcaucuucggggccaucgccggcuucaucgagaacgggugggagggcaugguggacggcugguacggguuccgccaccagaacagcgagggcaaggggcaggccgcggaccugaaguccacccaggccgccaucgaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgcggaggacaugggcaacgggugcuucaagaucuaccacaagugcgacaacgccugcaucggcuccauccgcaacgggaccuacgaccacgacgucuaccgcgacgaggcccucaacaaccgguuccagaucaagggcguggagcugaaguccggguacaaggacuggauccuguggaucuccuucgccaucagcugcuuccuccugugcguggcccugcucggcuucaucaugugggcgugccagaagggcaacauccgcugcaacaucugcaucuga

SEQ ID NO: 73531 - RNA, 1701 nt, Artificial Sequence
  derived and/or modified sequence opt1 from hemagglutinin__InfluenzaA__AIJ10736
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcaccaucggggagaucugcgacagcccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcgcaucaccgugagcacgaagcggucccagcaggccgugaucccgaacaucggcagccgcccccggauccgcaacauccccagccggaucuccaucuacuggaccaucgucaagcccggcgacauccugcucaucaacagcaccgggaaccugaucgccccgcgcggcuacuucaagauccgguccgggaaguccuccaucaugcgcagcgacgcccccaucggcaagugcaaguccgagugcaucacccccaacggcagcauccccaacgacaagccguuccagaacgugaaccggaucacguacggggccugcccccgcuacgugaagcaguccacccugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 73532 - RNA, 1701 nt, Artificial Sequence
  derived and/or modified sequence opt1 from hemagglutinin__InfluenzaA__AIJ10737
augaagaccaucaucgcccugagcuacauccucugccugguggucgcccagaagcugcccggcaacgacaacuccaccgcgacgcucugccuggggcaccacgccgugccgaacggcaccaucgugaagaccaucaccaacgaccgcaucgaggucacgaacgccaccgagcuggugcagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcagccucguggccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcgcaguccagcgggcgcaucaccguguccaccaagcggagccagcaggccgucaucccgaacaucggcagccgcccccggauccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgucaagcagagcacgcugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73533 - RNA, 1701 nt, Artificial Sequence
  derived and/or modified sequence opt1 from hemagglutinin__InfluenzaA__AIJ10738
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcacuucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73534 - RNA, 1701 nt, Artificial Sequence; identical to SEQ ID NO: 70461
  derived and/or modified sequence opt1 from hemagglutinin__InfluenzaA__AIJ10740

SEQ ID NO: 73535 - RNA, 1701 nt, Artificial Sequence; identical to SEQ ID NO: 70461
  derived and/or modified sequence opt1 from hemagglutinin__InfluenzaA__AIJ10741

SEQ ID NO: 73536 - RNA, 1701 nt, Artificial Sequence
  derived and/or modified sequence opt1 from hemagglutinin__InfluenzaA__AIJ10742
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguggccaccaagcggucccagcaggccgugaucccgaacaucggcagccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggcgugcccccgcuacgugaagcaguccacgcugaagcucgccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 73537 - RNA, 1701 nt, Artificial Sequence
  derived and/or modified sequence opt1 from hemagglutinin__InfluenzaA__AIJ10743
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaucaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcacguacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73538 - RNA, 1701 nt, Artificial Sequence
  derived and/or modified sequence opt1 from hemagglutinin__InfluenzaA__AIJ10744
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagcggacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 73539 - RNA, 1701 nt, Artificial Sequence; identical to SEQ ID NO: 71002
  derived and/or modified sequence opt1 from hemagglutinin__InfluenzaA__AIJ10745

SEQ ID NO: 73540 - RNA, 1701 nt, Artificial Sequence
  derived and/or modified sequence opt1 from hemagglutinin__InfluenzaA__AIJ10747
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacgacuuccagaacaagaagugggaccuguucguggagcgguccaaggccuacagcaacugcuaccccuacgacgugccggacuacgcgucccugcgcagccucgucgccuccagcggcacccuggaguucaacaacgagaacuucaacuggacgggcgugacccagaacgggaccuccagcgccugcauccggcgcuccaacaacagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugagcaccaagcggucccagcaggccgugaucccgaacaucgggagccgcccccggauccgcaacauccccagccggaucuccaucuacuggacgaucgucaagcccggcgacauccugcucaucaacagcaccggcaaccugaucgccccgcgcggguacuucaagauccgguccggcaagagcuccaucaugcgcagcgacgcccccaucgggaagugcaaguccgagugcaucacccccaacggcagcauccccaacgacaagccguuccagaacgugaaccggaucaccuacggcgccugcccccgcuacgugaagcaguccacgcugaagcucgcgaccgggaugcggaacguccccgagaagcagacccgcggcaucuucggggccaucgccggcuucaucgagaacgggugggagggcaugguggacggcugguacggguuccggcaccagaacagcgagggccgcgggcaggccgccgaccugaaguccacccaggcggccaucgaccagaucaacggcaagcugaaccggcucaucgggaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcucaagagcggguacaaggacuggauccuguggaucuccuucgccaucagcugcuuccugcugugcguggcccugcucggcuucaucaugugggccugccagaagggcaacauccgcugcaacaucugcaucuga

SEQ ID NO: 73541 - RNA, 1701 nt, Artificial Sequence; identical to SEQ ID NO: 73540
  derived and/or modified sequence opt1 from hemagglutinin__InfluenzaA__AIJ10748

SEQ ID NO: 73542 - RNA, 1701 nt, Artificial Sequence
  derived and/or modified sequence opt1 from hemagglutinin__InfluenzaA__AIJ10750
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucauccgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 73543 - RNA, 1701 nt, Artificial Sequence
  derived and/or modified sequence opt1 from hemagglutinin__InfluenzaA__AIJ10752
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaugagcugcuuccugcugugcguggcccugcucggcuucaucaugugggccugccagaaggggaacauccgcugcaacaucugcaucuga

SEQ ID NO: 73544 - RNA, 1701 nt, Artificial Sequence
  derived and/or modified sequence opt1 from hemagglutinin__InfluenzaA__AIJ10753
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacaacagcuucuucucccgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagaagcagacccggggcaucuucggggccaucgccggcuucaucgagaacggcugggaggggaugauggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 73545 - RNA, 1701 nt, Artificial Sequence; identical to SEQ ID NO: 71002
  derived and/or modified sequence opt1 from hemagglutinin__InfluenzaA__AIJ10754

SEQ ID NO: 73546 - RNA, 1701 nt, Artificial Sequence
  derived and/or modified sequence opt1 from hemagglutinin__InfluenzaA__AIJ10755
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccagagcgccaucgaccagaucaacggcaagcugaaccgccucaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 73547 - RNA, 1701 nt, Artificial Sequence; identical to SEQ ID NO: 71002
  derived and/or modified sequence opt1 from hemagglutinin__InfluenzaA__AIJ10756

SEQ ID NO: 73548 - RNA, 1701 nt, Artificial Sequence
  derived and/or modified sequence opt1 from hemagglutinin__InfluenzaA__AIJ10757
augaagaccaucaucgcccugagcuacauccucugccuggugaucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggugcugcucggguucaucaugugggccugccagaagggcaacauccggugcaacaucugcaucuga

SEQ ID NO: 73549 - RNA, 1701 nt, Artificial Sequence
  derived and/or modified sequence opt1 from hemagglutinin__InfluenzaA__AIJ10758
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccagcggccggaucaccgugagcaccaagcgcucccagcaggccgugaucccgaacaucggcagccggccccgcauccggaacauccccucccgcaucagcaucuacuggaccaucgucaagcccggggacauccugcugaucaacuccacgggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacggcugggaggggaugauggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcguggagcucaaguccggcuacaaggacuggauccuguggaucagcuucgccaucagcugcuuccugcucugcgucgcccugcugggguucaucaugugggcgugccagaagggcaacauccggugcaacaucugcaucuga

SEQ ID NO: 73550 - RNA, 1701 nt, Artificial Sequence; identical to SEQ ID NO: 71002
  derived and/or modified sequence opt1 from hemagglutinin__InfluenzaA__AIJ10759

SEQ ID NO: 73551 - RNA, 1701 nt, Artificial Sequence
  derived and/or modified sequence opt1 from hemagglutinin__InfluenzaA__AIJ10760
augaagaccaucaucgcccugagcuacauccucugccuggugaucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 73552 - RNA, 1701 nt, Artificial Sequence
  derived and/or modified sequence opt1 from hemagglutinin__InfluenzaA__AIJ10761
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccggaacgaggcccucaacaagcgcuuccagaucaagggcgucgagcucaagagcggcuacaaggacuggauccuguggaucuccuucgccaucagcugcuuccugcugugcguggugcugcucggguucaucaugugggccugccagaagggcaacauccggugcaacaucugcaucuga

SEQ ID NO: 73553 - RNA, 1701 nt, Artificial Sequence; identical to SEQ ID NO: 72900
  derived and/or modified sequence opt1 from hemagglutinin__InfluenzaA__AIJ10762

SEQ ID NO: 73554 - RNA, 1701 nt, Artificial Sequence; identical to SEQ ID NO: 72900
  derived and/or modified sequence opt1 from hemagglutinin__InfluenzaA__AIJ10763

SEQ ID NO: 73555 - RNA, 1701 nt, Artificial Sequence; identical to SEQ ID NO: 72900
  derived and/or modified sequence opt1 from hemagglutinin__InfluenzaA__AIJ10764

SEQ ID NO: 73556 - RNA, 1701 nt, Artificial Sequence; identical to SEQ ID NO: 72900
  derived and/or modified sequence opt1 from hemagglutinin__InfluenzaA__AIJ10765

SEQ ID NO: 73557 - RNA, 1701 nt, Artificial Sequence; identical to SEQ ID NO: 72900
  derived and/or modified sequence opt1 from hemagglutinin__InfluenzaA__AIJ10766

SEQ ID NO: 73558 - RNA, 1701 nt, Artificial Sequence; identical to SEQ ID NO: 72900
  derived and/or modified sequence opt1 from hemagglutinin__InfluenzaA__AIJ10767

SEQ ID NO: 73559 - RNA, 1701 nt, Artificial Sequence
  derived and/or modified sequence opt1 from hemagglutinin__InfluenzaA__AIJ10768
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacauccccgagaagcagacccggggcaucuucggggccaucgccggcuucaucgagaacggcugggaggggauggucgacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgugcugcucggguucaucaugugggccugccagaagggcaacauccggugcaacaucugcaucuga

SEQ ID NO: 73560 - RNA, 1701 nt, Artificial Sequence
  derived and/or modified sequence opt1 from hemagglutinin__InfluenzaA__AIJ10769
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccaguccggcaagagcuccaucaugcgcagcgacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggugcugcucggguucaucaugugggccugccagaagggcaacauccgcugcaacaucugcaucuga

SEQ ID NO: 73561 - RNA, 1701 nt, Artificial Sequence; identical to SEQ ID NO: 72900
  derived and/or modified sequence opt1 from hemagglutinin__InfluenzaA__AIJ10770

SEQ ID NO: 73562 - RNA, 1701 nt, Artificial Sequence; identical to SEQ ID NO: 72900
  derived and/or modified sequence opt1 from hemagglutinin__InfluenzaA__AIJ10771

SEQ ID NO: 73563 - RNA, 1701 nt, Artificial Sequence; identical to SEQ ID NO: 72900
  derived and/or modified sequence opt1 from hemagglutinin__InfluenzaA__AIJ10772

SEQ ID NO: 73564 - RNA, 1701 nt, Artificial Sequence; identical to SEQ ID NO: 72900
  derived and/or modified sequence opt1 from hemagglutinin__InfluenzaA__AIJ10773

SEQ ID NO: 73565 - RNA, 1701 nt, Artificial Sequence
  derived and/or modified sequence opt1 from hemagglutinin__InfluenzaA__AIJ10774
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccagagcgccaucgaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgugcugcucggguucaucaugugggccugccagaagggcaacauccggugcaacaucugcaucuga

SEQ ID NO: 73566 - RNA, 1701 nt, Artificial Sequence
  derived and/or modified sequence opt1 from hemagglutinin__InfluenzaA__AIJ10776
augaagaccaucaucgcccugagcugcauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagauguccaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggugcugcucggguucaucaugugggccugccagaagggcaacauccggugcaacaucugcaucuga

SEQ ID NO: 73567 - RNA, 1701 nt, Artificial Sequence; identical to SEQ ID NO: 72900
  derived and/or modified sequence opt1 from hemagglutinin__InfluenzaA__AIJ10777

SEQ ID NO: 73568 - RNA, 1701 nt, Artificial Sequence; identical to SEQ ID NO: 72900
  derived and/or modified sequence opt1 from hemagglutinin__InfluenzaA__AIJ10778

SEQ ID NO: 73569 - RNA, 1701 nt, Artificial Sequence
  derived and/or modified sequence opt1 from hemagglutinin__InfluenzaA__AIJ10780
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacuccuuccagaacaagaagugggaccuguucguggagcggagcaaggccuacuccaacugcuaccccuacgacgugccggacuacgcgagccugcgcucccucgucgccagcuccggcacccuggaguucaacaacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugauggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggacaucgagaaguacguggaggacacgaagaucgaccucugguccuacaacgccgagcugcuggucgcccucgagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccaucuccugcuuccugcugugcgucgcccuccugggcuucaucaugugggcgugccagaaggggaacauccggugcaacaucugcaucuga

SEQ ID NO: 73570 - RNA, 1701 nt, Artificial Sequence; identical to SEQ ID NO: 72900
  derived and/or modified sequence opt1 from hemagglutinin__InfluenzaA__AIJ10781

SEQ ID NO: 73571 - RNA, 1701 nt, Artificial Sequence; identical to SEQ ID NO: 72900
  derived and/or modified sequence opt1 from hemagglutinin__InfluenzaA__AIJ10782

SEQ ID NO: 73572 - RNA, 1701 nt, Artificial Sequence
  derived and/or modified sequence opt1 from hemagglutinin__InfluenzaA__AIJ10783
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggugggggugacgcagaacggcaccagcuccgccugcauccgggggagcaacuccagcuucuucucccgccugaacuggcucacccaccugaacuucaaguaccccgcccugaacgucaccaugcccaacaacgagcaguucgacaagcucuacaucuggggcgugcaccaccccgggacggacaaggaccagaucuuccuguacgcgcagagcuccggccggaucaccgugagcaccaagcgcagccagcaggccgucaucccgaacaucggcucccggccccgcauccggaacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgucaagcaguccacccugaagcucgcgacggggaugcgcaacgugcccgagaagcagacccggggcaucuucggggccaucgccggcuucaucgagaacggcugggaggggaugaaggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 73573 - RNA, 1701 nt, Artificial Sequence; identical to SEQ ID NO: 73572
  derived and/or modified sequence opt1 from hemagglutinin__InfluenzaA__AIJ10784

SEQ ID NO: 73574 - RNA, 1701 nt, Artificial Sequence
  derived and/or modified sequence opt1 from hemagglutinin__InfluenzaA__AIJ10785
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccagagcgccaucgaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 73575 - RNA, 1701 nt, Artificial Sequence; identical to SEQ ID NO: 73572
  derived and/or modified sequence opt1 from hemagglutinin__InfluenzaA__AIJ10786

SEQ ID NO: 73576 - RNA, 1701 nt, Artificial Sequence
  derived and/or modified sequence opt1 from hemagglutinin__InfluenzaA__AIJ10787
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggugggggugacgcagaacggcaccagcuccgccugcauccgggggagcaacuccagcuucuucucccgccugaacuggcucacccaccugaacuucaaguaccccgcccugaacgucaccaugcccaacaacgagcaguucgacaagcucuacaucuggggcgugcaccaccccgggacggacaaggaccagaucuuccuguacgcgcagagcuccggccggaucaccgugagcaccaagcgcagccagcaggccgucaucccgaacaucggcucccggccccgcauccggaacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgucaagcaguccacccugaagcucgcgacggggaugcgcaacgugcccgagaagcagacccggggcaucuucggggccaucgccggcuucaucgagaacggcugggaggggaugaaggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccggaucaagggcgucgagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 73577 - RNA, 1701 nt, Artificial Sequence; identical to SEQ ID NO: 73574
  derived and/or modified sequence opt1 from hemagglutinin__InfluenzaA__AIJ10788

SEQ ID NO: 73578 - RNA, 1701 nt, Artificial Sequence; identical to SEQ ID NO: 73574
  derived and/or modified sequence opt1 from hemagglutinin__InfluenzaA__AIJ10789

SEQ ID NO: 73579 - RNA, 1701 nt, Artificial Sequence; identical to SEQ ID NO: 73572
  derived and/or modified sequence opt1 from hemagglutinin__InfluenzaA__AIJ10790

SEQ ID NO: 73580 - RNA, 1701 nt, Artificial Sequence; identical to SEQ ID NO: 72900
  derived and/or modified sequence opt1 from hemagglutinin__InfluenzaA__AIJ10791

SEQ ID NO: 73581 - RNA, 1701 nt, Artificial Sequence
  derived and/or modified sequence opt1 from hemagglutinin__InfluenzaA__AIJ10792
augaagaccaucaucgcccugagcuacauccucugccugguguucgcccagaagcugcccggcgacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggugcugcucggguucaucaugugggccugccagaagggcaacauccggugcaacaucugcaucuga

SEQ ID NO: 73582 - RNA, 1701 nt, Artificial Sequence; identical to SEQ ID NO: 70891
  derived and/or modified sequence opt1 from hemagglutinin__InfluenzaA__AIJ29347

SEQ ID NO: 73583 - RNA, 1701 nt, Artificial Sequence
  derived and/or modified sequence opt1 from hemagglutinin__InfluenzaA__AIJ29349
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcaacuccagcuucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 73584 - RNA, 1701 nt, Artificial Sequence
  derived and/or modified sequence opt1 from hemagglutinin__InfluenzaA__AIJ29351
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugccugcugcugugcguggcccuccugggcuucaucaugugggccugccagaaggggaacauccgcugcaacaucugcaucuga

SEQ ID NO: 73585 - RNA, 1701 nt, Artificial Sequence; identical to SEQ ID NO: 70488
  derived and/or modified sequence opt1 from hemagglutinin__InfluenzaA__AIJ29353

SEQ ID NO: 73586 - RNA, 1701 nt, Artificial Sequence
  derived and/or modified sequence opt1 from hemagglutinin__InfluenzaA__AIJ29355
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggucccgcauccggaacauccccagccgcaucuccaucuacuggaccaucgucaagcccggcgacauccugcucaucaacagcaccgggaaccugaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucacguacggggccugcccgcgguacgugaagcaguccacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcucaagagcggcuacaaggacuggauccuguggaucagcuucgccaucuccugcuuccugcugugcguggcccugcucggcuucaucaugugggccugccagaaggggaacauccggugcaacaucugcaucuga

SEQ ID NO: 73587 - RNA, 1701 nt, Artificial Sequence; identical to SEQ ID NO: 70082
  derived and/or modified sequence opt1 from hemagglutinin__InfluenzaA__AIJ29357

SEQ ID NO: 73588 - RNA, 1701 nt, Artificial Sequence
  derived and/or modified sequence opt1 from hemagglutinin__InfluenzaA__AIJ29359
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggccaucaacaaccgguuccagaucaagggggucgagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 73589 - RNA, 1701 nt, Artificial Sequence
  derived and/or modified sequence opt1 from hemagglutinin__InfluenzaA__AIJ29361
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgucucccugcgcagccucguggcguccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcccaguccagcgggcgcaucaccguguccaccaagcggagccagcaggcggucaucccgaacaucggcagccgcccccggauccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgcgaucgccggguucaucgagaacggcugggagggcaugguggacgggugguacggcuuccggcaccagaacuccgaggggcgcggccaggccgccgaccucaagagcacccaggccgcgaucgaccagaucaacgggaagcugaaccggcugaucggcaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacgucuaccgcgacgaggcgcucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73590 - RNA, 1701 nt, Artificial Sequence; identical to SEQ ID NO: 71048
  derived and/or modified sequence opt1 from hemagglutinin__InfluenzaA__AIL93623

SEQ ID NO: 73591 - RNA, 1701 nt, Artificial Sequence
  derived and/or modified sequence opt1 from hemagglutinin__InfluenzaA__AIL93634
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcaacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73592 - RNA, 1701 nt, Artificial Sequence
  derived and/or modified sequence opt1 from hemagglutinin__InfluenzaA__AIL93645
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuuccgguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggagccagcaggccgugaucccgaacaucggcucccgcccccggauccgcaacauccccagccggaucuccaucuacuggaccaucgucaagcccggggacauccugcucaucaacagcacgggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 73593 - RNA, 1701 nt, Artificial Sequence; identical to SEQ ID NO: 71002
  derived and/or modified sequence opt1 from hemagglutinin__InfluenzaA__AIL93657

SEQ ID NO: 73594 - RNA, 1701 nt, Artificial Sequence; identical to SEQ ID NO: 71002
  derived and/or modified sequence opt1 from hemagglutinin__InfluenzaA__AIL93669

SEQ ID NO: 73595 - RNA, 1701 nt, Artificial Sequence
  derived and/or modified sequence opt1 from hemagglutinin__InfluenzaA__AIL93681
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcagcgccggguccggcaucaucaucagcgacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 73596 - RNA, 1701 nt, Artificial Sequence; identical to SEQ ID NO: 73592
  derived and/or modified sequence opt1 from hemagglutinin__InfluenzaA__AIL93692

SEQ ID NO: 73597 - RNA, 1701 nt, Artificial Sequence; identical to SEQ ID NO: 73592
  derived and/or modified sequence opt1 from hemagglutinin__InfluenzaA__AIL93716

SEQ ID NO: 73598 - RNA, 1701 nt, Artificial Sequence; identical to SEQ ID NO: 71002
  derived and/or modified sequence opt1 from hemagglutinin__InfluenzaA__AIL93728

SEQ ID NO: 73599 - RNA, 1701 nt, Artificial Sequence; identical to SEQ ID NO: 71002
  derived and/or modified sequence opt1 from hemagglutinin__InfluenzaA__AIL93740

SEQ ID NO: 73600 - RNA, 1701 nt, Artificial Sequence
  derived and/or modified sequence opt1 from hemagglutinin__InfluenzaA__AIL93752
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgaccggccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacugggccggggugacgcagaacggcaccuccagcgccugcauccgcggguccaacagcuccuucuucagccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccgcaucaccguguccaccaagaagucccagcaggccgugaucccgaacaucggcagccggccccgcauccggaacauccccagccgcaucagcaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcucgccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 73601 - RNA, 1701 nt, Artificial Sequence
  derived and/or modified sequence opt1 from hemagglutinin__InfluenzaA__AIL93764
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccgcaucgaggugaccaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgccucccugcgcagccucgucgcguccagcggcacgcuggaguucaacaacgaguccuucaacugggccggggugacccagaacggcaccagcuccgccugcauccgggggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccggaucaccgugagcaccaagcgcagccagcaggccgugaucccgaacaucggcucccggccccgcauccggaacauccccagccgcaucuccaucuacuggacgaucgucaagcccggggacauccugcucaucaacagcaccggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacgcugaagcucgcgaccgggaugcgcaacguccccgagaagcagacccggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccgcaacgagaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 73602 - RNA, 1701 nt, Artificial Sequence; identical to SEQ ID NO: 71002
  derived and/or modified sequence opt1 from hemagglutinin__InfluenzaA__AIL93776

SEQ ID NO: 73603 - RNA, 1701 nt, Artificial Sequence; identical to SEQ ID NO: 71002
  derived and/or modified sequence opt1 from hemagglutinin__InfluenzaA__AIL93788

SEQ ID NO: 73604 - RNA, 1701 nt, Artificial Sequence; identical to SEQ ID NO: 71002
  derived and/or modified sequence opt1 from hemagglutinin__InfluenzaA__AIL93812

SEQ ID NO: 73605 - RNA, 1701 nt, Artificial Sequence; identical to SEQ ID NO: 71002
  derived and/or modified sequence opt1 from hemagglutinin__InfluenzaA__AIL93824

SEQ ID NO: 73606 - RNA, 1701 nt, Artificial Sequence; identical to SEQ ID NO: 73595
  derived and/or modified sequence opt1 from hemagglutinin__InfluenzaA__AIL93836

SEQ ID NO: 73607 - RNA, 1701 nt, Artificial Sequence
  derived and/or modified sequence opt1 from hemagglutinin__InfluenzaA__AIL93847
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcagcgccggguccggcaucaucaucagcgacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucagccugggggccaucugcuucuggaugugcuccaacggcagccugcagugccggaucugcaucuga

SEQ ID NO: 73608 - RNA, 1701 nt, Artificial Sequence; identical to SEQ ID NO: 73592
  derived and/or modified sequence opt1 from hemagglutinin__InfluenzaA__AIL93858

SEQ ID NO: 73609 - RNA, 1701 nt, Artificial Sequence; identical to SEQ ID NO: 71002
  derived and/or modified sequence opt1 from hemagglutinin__InfluenzaA__AIL93870

SEQ ID NO: 73610 - RNA, 1701 nt, Artificial Sequence
  derived and/or modified sequence opt1 from hemagglutinin__InfluenzaA__AIL93882
augaagaccaucaucgcccugagcuacauccucugccugguguucgcccagaagcccccgggcaacgacaacuccaccgcgacgcugugccucgggcaccacgccguccccaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuacccguacgacgugcccgacuacgcgucccugcgcagccuggucgccuccagcggcacccucgaguucaacaacgaguccuucaacugggccggggugacgcagaacggcaccagcuccgccugcauccgggggagcaacuccagcuucuucucccgccugaacuggcugacccaccucaacuucaaguaccccgcgcugaacgugaccaugcccaacaacgagcaguucgacaagcuguacaucuggggcguccaccacccggggacggacaaggaccagaucuuccucuacgcccagagcuccggccggaucaccgugagcaccaagcgcagccagcaggccgugauccccaacaucggcucccggccccgcauccggaacauccccagccgcaucuccaucuacuggaccaucgucaagccgggggacauccugcugaucaacagcacgggcaaccucaucgcgccccggggguacuucaagauccgcuccggcaagagcuccaucaugcggagcgacgcccccaucggcaagugcaaguccgagugcaucacccccaacgggagcaucccgaacgacaagcccuuccagaacgugaaccgcaucaccuacggcgccugcccccgguacgugaagcaguccacccugaagcuggccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacgucgaggacacgaagaucgaccugugguccuacaacgccgagcugcucguggcccuggagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 73611 - RNA, 1701 nt, Artificial Sequence; identical to SEQ ID NO: 71002
  derived and/or modified sequence opt1 from hemagglutinin__InfluenzaA__AIL93894

SEQ ID NO: 73612 - RNA, 1701 nt, Artificial Sequence
  derived and/or modified sequence opt1 from hemagglutinin__InfluenzaA__AIL93906
augaaggccauccuggugguccuccuguacaccuucgccaccgcgaacgccgacacgcugugcaucggcuaccacgccaacaacagcaccgacaccguggacaccgugcucgagaagaacgucacggugacccacuccaucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagauguuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccacggccgaccagcagucccuguaccagaacgccgacgccuacgucuucgugggcaccagcaaguacuccaagaaguucaagcccgagaucgccauccggccgaaggugcgcgaccaggagggccggaugaacuacuacuggacccugaucgagcccggggacaagaucaccuucgaggcgacgggcaaccucgucgugccccgcuacgccuucgccauggagcggaacgccgggagcggcaucaucaucuccgacacccccgugcacgacugcaacacgaccugccagaccccggagggcgccaucaacaccagccugcccuuccagaacauccaccccaucaccaucgggaagugccccaaguacgucaaguccaccaagcugcgccucgcgacgggccugcggaacgugccgagcauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgucaagaaccucuacgagaaggugcggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgucaagcucgagagcacccggaucuaccagauccuggcgaucuacuccaccguggccagcucccuggugcucgucgugagccugggggccaucagcuucuggaugugcuccaacggcagccugcagugccgcaucugcaucuga

SEQ ID NO: 73613 - RNA, 1701 nt, Artificial Sequence
  derived and/or modified sequence opt1 from hemagglutinin__InfluenzaA__AIL93917
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgaccggccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacugggccggggugacgcagaacggcaccuccagcgccugcauccgcggguccaacagcuccuucuucagccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccgcaucaccguguccaccaagcggagccagcaggccgugaucccgaacaucggcagccgcccccggauccgcaacauccccucccggaucagcaucuacuggaccaucgucaagcccggggacauccugcucaucaacuccacgggcaaccugaucgccccgcgcggguacuucaagauccggagcggcaaguccagcaucaugcgcuccgacgcccccaucggcaagugcaagagcgagugcaucacccccaacggguccauccccaacgacaagccguuccagaacgugaaccggaucaccuacggcgcgugcccccgcuacgugaagcagagcacccugaagcucgccacggggaugcggaacguccccgagaagcagacccgcggcaucuucggggccaucgccggcuucaucgagaacggcugggaggggaugguggacggcugguacggguuccggcaccagaacuccgagggccgcgggcaggccgcggaccucaagagcacccaggccgccaucgaccagaucaacggcaagcugaaccggcugaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagaugcgcgagaacgcggaggacaugggcaacgggugcuucaagaucuaccacaagugcgacaacgccugcaucggcagcauccggaacgggacguacgaccacgacguguaccgcgacgaggcccugaacaaccgguuccagaucaagggcgucgagcucaaguccggcuacaaggacuggauccuguggaucagcuucgccaucuccugcuuccugcucugcguggcccugcugggguucaucaugugggcgugccagaagggcaacauccgcugcaacaucugcaucuga

SEQ ID NO: 73614 - RNA, 1701 nt, Artificial Sequence; identical to SEQ ID NO: 71048
  derived and/or modified sequence opt1 from hemagglutinin__InfluenzaA__AIL93929

SEQ ID NO: 73615 - RNA, 1701 nt, Artificial Sequence
  derived and/or modified sequence opt1 from hemagglutinin__InfluenzaA__AIL93940
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucagcccccugcaccucgggaagugcaacaucgccggcuggauccuggggaacccggagugcgagucccugagcaccgccuccagcugguccuacaucguggagaccagcuccagcgacaacggcacgugcuaccccggcgacuucaucaacuacgaggagcuccgggagcagcuguccagcguguccagcuucgagcgcuucgagaucuuccccaagaccuccagcuggcccaaccacgacuccaacaagggggucaccgcggccugcccgcacgccggcgccaagagcuucuacaagaaccugaucuggcucgugaagaaggggaacuccuaccccaagcugagccagagcuacaucaacgacaagggcaaggaggugcugguccucugggggauccaccaccccuccaccacggcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucaccauggagcgcaacgccggguccggcaucaucaucagcgacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgccuccagccuggugcucguggucagccugggggcgaucuccuucuggaugugcagcaacggcucccugcagugccggaucugcaucuga

SEQ ID NO: 73616 - RNA, 1701 nt, Artificial Sequence; identical to SEQ ID NO: 71002
  derived and/or modified sequence opt1 from hemagglutinin__InfluenzaA__AIL93951

SEQ ID NO: 73617 - RNA, 1701 nt, Artificial Sequence; identical to SEQ ID NO: 71002
  derived and/or modified sequence opt1 from hemagglutinin__InfluenzaA__AIL93963

SEQ ID NO: 73618 - RNA, 1701 nt, Artificial Sequence; identical to SEQ ID NO: 70866
  derived and/or modified sequence opt1 from hemagglutinin__InfluenzaA__AIL93975

SEQ ID NO: 73619 - RNA, 1701 nt, Artificial Sequence; identical to SEQ ID NO: 73595
  derived and/or modified sequence opt1 from hemagglutinin__InfluenzaA__AIL93987

SEQ ID NO: 73620 - RNA, 1701 nt, Artificial Sequence; identical to SEQ ID NO: 71002
  derived and/or modified sequence opt1 from hemagglutinin__InfluenzaA__AIL93998

SEQ ID NO: 73621 - RNA, 1701 nt, Artificial Sequence; identical to SEQ ID NO: 73592
  derived and/or modified sequence opt1 from hemagglutinin__InfluenzaA__AIL94010

SEQ ID NO: 73622 - RNA, 1701 nt, Artificial Sequence; identical to SEQ ID NO: 73592
  derived and/or modified sequence opt1 from hemagglutinin__InfluenzaA__AIL94022

SEQ ID NO: 73623 - RNA, 1701 nt, Artificial Sequence
  derived and/or modified sequence opt1 from hemagglutinin__InfluenzaA__AIL94046
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgaccggccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacugggccggggugacgcagaacggcaccuccagcgccugcauccgcggguccaacagcuccuucuucagccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccgcaucaccguguccaccaagcggagccagcaggccgugaucccgaacaucggcagccgcccccggauccgcaacauccccucccggaucagcaucuacuggaccaucgucaagcccggggacauccugcucaucaacuccacgggcaaccugaucgccccgcgcggguacuucaagauccggagcggcaaguccagcaucaugcgcuccgacgcccccaucggcaagugcaagagcgagugcaucacccccaacggguccauccccaacgacaagccguuccagaacgugaaccggaucaccuacggcgcgugcccccgcuacgugaagcagagcacccugaagcucgccacggggaugcggaacguccccgagaagcagacccgcggcaucuucggggccaucgccggcuucaucgagaacggcugggaggggaugguggacggcugguacggguuccggcaccagaacuccgagggccgcgggcaggccgcggaccucaagagcacccaggccgccaucgaccagaucaacggcaagcugaaccggcugaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccggaacgggacguacgaccacgacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaugugggcgugccagaagggcaacauccgcugcaacaucugcaucuga

SEQ ID NO: 73624 - RNA, 1701 nt, Artificial Sequence
  derived and/or modified sequence opt1 from hemagglutinin__InfluenzaA__AIL94058
augaaggccauccuggugguccuccuguacaccuucgcccccgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgccccgcugcaccucgggaagugcaacaucgccggcuggauccuggggaaccccgagugcgagagccuguccaccgcgagcuccuggagcuacaucguggagaccuccagcuccgacaacgggaccugcuaccccggcgacuucaucaacuacgaggagcuccgggagcagcugagcuccgugagcuccuucgagcgcuucgagaucuuccccaagacgagcuccuggccgaaccacgacagcaacaagggcgucaccgccgccugcccccacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucacgaucgagcgcagcgccggguccggcaucaucaucagcgacaccccggugcacgacugcaacacgaccugccagacccccgagggcgccaucaacaccucccugcccuuccagaacauccaccccaucaccaucgggaagugcccgaaguacgucaagagcaccaagcugcggcucgccacgggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 73625 - RNA, 1701 nt, Artificial Sequence; identical to SEQ ID NO: 73595
  derived and/or modified sequence opt1 from hemagglutinin__InfluenzaA__AIL94069

SEQ ID NO: 73626 - RNA, 1701 nt, Artificial Sequence; identical to SEQ ID NO: 71048
  derived and/or modified sequence opt1 from hemagglutinin__InfluenzaA__AIL94080

SEQ ID NO: 73627 - RNA, 1701 nt, Artificial Sequence; identical to SEQ ID NO: 73592
  derived and/or modified sequence opt1 from hemagglutinin__InfluenzaA__AIL94235

SEQ ID NO: 73628 - RNA, 1701 nt, Artificial Sequence; identical to SEQ ID NO: 71048
  derived and/or modified sequence opt1 from hemagglutinin__InfluenzaA__AIL94247

SEQ ID NO: 73629 - RNA, 1701 nt, Artificial Sequence
  derived and/or modified sequence opt1 from hemagglutinin__InfluenzaA__AIL94258
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccgcaucgaggugaccaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgccucccugcgcagccucgucgcguccagcggcacgcuggaguucaacaacgaguccuucaacugggccggggugacccagaacggcaccagcuccgccugcauccgggggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccggaucaccgugagcaccaagcgcagccagcaggccgugaucccgaacaucggcucccggccccgcauccggaacauccccagccgcaucuccaucuacuggacgaucgucaagcccggggacauccugcucaucaacagcaccggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacgcugaagcucgcgaccgggaugcgcaacguccccgagaagcagacccggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 73630 - RNA, 1701 nt, Artificial Sequence
  derived and/or modified sequence opt1 from hemagglutinin__InfluenzaA__AIL94270
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 73631 - RNA, 1701 nt, Artificial Sequence; identical to SEQ ID NO: 71002
  derived and/or modified sequence opt1 from hemagglutinin__InfluenzaA__AIL94282

SEQ ID NO: 73632 - RNA, 1701 nt, Artificial Sequence; identical to SEQ ID NO: 71002
  derived and/or modified sequence opt1 from hemagglutinin__InfluenzaA__AIL94294

SEQ ID NO: 73633 - RNA, 1701 nt, Artificial Sequence
  derived and/or modified sequence opt1 from hemagglutinin__InfluenzaA__AIL94306
augaagaccaucaccgcccugagcuacauccucugccuggccuucgcgcagaagcccccgggcaacgacaacuccacggccacccugugccucgggcaccacgccgugcccaacggcaccaucgucaagaccaucacgaacgaccgcaucgaggugaccaacgccaccgagcuggugcagaacagcuccaucggggagaucugcgacagcccccaccagauccuggacggcgagaacugcacccucaucgacgcccugcugggggacccccagugcgacggcuuccagaacaagaagugggaccucuucgucgagcgguccaaggcguacagcaacugcuacccguacgacgugcccgacuacgccucccugcgcagccugguggccuccagcggcacgcucgaguucaacaacgaguccuucaacugggccggggucacccagaacggcaccagcuccgcgugcauccgggggagcaacuccagcuucuucucccgccugaacuggcugacccaccucaacuucaaguaccccgcccugaacgugacgaugcccaacaacgagcaguucgacaagcuguacaucuggggcgugcaccacccggggaccgacaaggaccagaucuuccucuacgcccagagcuccggccggaucaccgucagcaccaagcgcagccagcaggccgugauccccaacaucggcucccggccccgcauccggaacauccccagccgcaucuccaucuacuggacgaucgugaagccgggggacauccugcugaucaacagcaccggcaaccucaucgcgccccggggguacuucaagauccgcuccggcaagagcuccaucaugcggagcgacgcccccaucggcaagugcaaguccgagugcaucacccccaacgggagcaucccgaacgacaagcccuuccagaacgucaaccgcaucaccuacggcgccugcccccgguacgugaagcaguccacgcugaagcuggccaccgggaugcgcaacgugcccgagaagcagacccggggcaucuucggggccaucgccggcuucaucgagaacggcugggaggggauggucgacggcugguacggguuccgccaccagaacagcgagggccgggggcaggcggccgaccucaaguccacccaggccgccaucgaccagaucaacggcaagcugaaccgccugaucggcaagacgaacgagaaguuccaccagaucgagaaggaguucagcgagguggaggggcggauccaggaccucgagaaguacguggaggacaccaagaucgaccugugguccuacaacgccgagcugcucgucgcgcuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcucaagagcggcuacaaggacuggauccuguggaucuccuucgccaucagcugcuuccugcucugcgucgcgcugcugggguucaucaugugggccugccagaagggcaacauccggugcaacaucugcaucuga

SEQ ID NO: 73634 - RNA, 1701 nt, Artificial Sequence
  derived and/or modified sequence opt1 from hemagglutinin__InfluenzaA__AIL94318
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccugaacagcgaggggcgcggccaggccgccgaccugaaguccacccaggcggccaucgaccagaucaacgggaagcucaaccggcugaucggcaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcugugcguggcccuccugggcuucaucaugugggccugccagaaggggaacauccgcugcaacaucugcaucuga

SEQ ID NO: 73635 - RNA, 1701 nt, Artificial Sequence; identical to SEQ ID NO: 70866
  derived and/or modified sequence opt1 from hemagglutinin__InfluenzaA__AIL94330

SEQ ID NO: 73636 - RNA, 1701 nt, Artificial Sequence; identical to SEQ ID NO: 71048
  derived and/or modified sequence opt1 from hemagglutinin__InfluenzaA__AIL94354

SEQ ID NO: 73637 - RNA, 1701 nt, Artificial Sequence; identical to SEQ ID NO: 71002
  derived and/or modified sequence opt1 from hemagglutinin__InfluenzaA__AIL94365

SEQ ID NO: 73638 - RNA, 1701 nt, Artificial Sequence
  derived and/or modified sequence opt1 from hemagglutinin__InfluenzaA__AIL94377
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccacugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 73639 - RNA, 1701 nt, Artificial Sequence
  derived and/or modified sequence opt1 from hemagglutinin__InfluenzaA__AIL94389
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcugauccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 73640 - RNA, 1701 nt, Artificial Sequence; identical to SEQ ID NO: 71002
  derived and/or modified sequence opt1 from hemagglutinin__InfluenzaA__AIL94411

SEQ ID NO: 73641 - RNA, 1701 nt, Artificial Sequence; identical to SEQ ID NO: 71002
  derived and/or modified sequence opt1 from hemagglutinin__InfluenzaA__AIL94423

SEQ ID NO: 73642 - RNA, 1701 nt, Artificial Sequence; identical to SEQ ID NO: 73595
  derived and/or modified sequence opt1 from hemagglutinin__InfluenzaA__AIL94435

SEQ ID NO: 73643 - RNA, 1701 nt, Artificial Sequence; identical to SEQ ID NO: 71002
  derived and/or modified sequence opt1 from hemagglutinin__InfluenzaA__AIL94446

SEQ ID NO: 73644 - RNA, 1701 nt, Artificial Sequence; identical to SEQ ID NO: 71002
  derived and/or modified sequence opt1 from hemagglutinin__InfluenzaA__AIL94458

SEQ ID NO: 73645 - RNA, 1701 nt, Artificial Sequence
  derived and/or modified sequence opt1 from hemagglutinin__InfluenzaA__AIL94470
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgcccacgacugcaacaccacgugccagaccccggagggcgccaucaacaccagccugcccuuccagaacauccaccccaucaccaucgggaagugccccaaguacgugaaguccacgaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucacgaacaaggugaacagcgugaucgagaagaugaacacccaguucaccgccgucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 73646 - RNA, 1701 nt, Artificial Sequence
  derived and/or modified sequence opt1 from hemagglutinin__InfluenzaA__AIL94481
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggaucaucuggaucuccuucgccaucagcugcuuccugcugugcguggcccugcugggguucaucaugugggcgugccagaagggcaacauccggugcaacaucugcaucuga

SEQ ID NO: 73647 - RNA, 1701 nt, Artificial Sequence
  derived and/or modified sequence opt1 from hemagglutinin__InfluenzaA__AIL94493
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagaagaacgccgggagcggcaucaucaucuccgacacccccgugcacgacugcaacaccacgugccagaccccggagggcgccaucaacaccagcuuccccuuccagaacauccaccccaucaccaucgggaagugccccaaguacgugaaguccacgaagcugcgccuggccaccggccuccggaacgucccgagcauccagucccgcgggcuguucggcgcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacagcgucaucgagaagaugaacacccaguucaccgcggugggcaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgugaagaaccuguacgagaagguccggaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcuggagagcacccggaucuaccagauccucgccaucuacuccaccgucgcgagcucccuggugcugguggucagccucggggccaucagcuucuggaugugcuccaacggcagccugcagugccgcaucugcaucuga

SEQ ID NO: 73648 - RNA, 1701 nt, Artificial Sequence; identical to SEQ ID NO: 73595
  derived and/or modified sequence opt1 from hemagglutinin__InfluenzaA__AIL94504

SEQ ID NO: 73649 - RNA, 1701 nt, Artificial Sequence; identical to SEQ ID NO: 71002
  derived and/or modified sequence opt1 from hemagglutinin__InfluenzaA__AIL94515

SEQ ID NO: 73650 - RNA, 1701 nt, Artificial Sequence; identical to SEQ ID NO: 71002
  derived and/or modified sequence opt1 from hemagglutinin__InfluenzaA__AIL94527

SEQ ID NO: 73651 - RNA, 1701 nt, Artificial Sequence
  derived and/or modified sequence opt1 from hemagglutinin__InfluenzaA__AIL94539
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgcccacgacugcaacaccacgugccagaccccggagggcgccaucaacaccagccugcccuuccagaacauccaccccaucaccaucgggaagugccccaaguacgugaaguccacgaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucacgaacaaggugaacagcgugaucgagaagaugaacacccaguucaccgccgucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggaggucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 73652 - RNA, 1701 nt, Artificial Sequence; identical to SEQ ID NO: 73595
  derived and/or modified sequence opt1 from hemagglutinin__InfluenzaA__AIL94550

SEQ ID NO: 73653 - RNA, 1701 nt, Artificial Sequence
  derived and/or modified sequence opt1 from hemagglutinin__InfluenzaA__AIL94561
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagcggggcaacauccgcugcaacaucugcaucuga

SEQ ID NO: 73654 - RNA, 1701 nt, Artificial Sequence
  derived and/or modified sequence opt1 from hemagglutinin__InfluenzaA__AIL94573
augaaggccauccuggugguccuccuguacaccuucgccaccgcgaacgccgacacgcugugcaucggcuaccacgccaacaacagcaccgacaccguggacaccgugcucgagaagaacgucaucgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccgggagcggcaucaucaucuccgacacccccgugcacgacugcaacacgaccugccagaccccggagggcgccaucaacaccagccugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcgucuaccagauccuggccaucuacuccaccguggcgagcucccuggugcucgucgugagccugggggccaucagcuucuggaugugcuccaacggcagccugcagugccggaucugcaucuga

SEQ ID NO: 73655 - RNA, 1701 nt, Artificial Sequence
  derived and/or modified sequence opt1 from hemagglutinin__InfluenzaA__AIL94584
augaaggccauccuggugguccuccuguacaccuucgccaccgcgaacgccgacacgcugugcaucggcuaccacgccaacaacagcaccgacaccguggacaccgugcucgagaagaacaucacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcugucccagagcuacaucaacgacaagggcaaggaggugcuggugcucugggggauccaccaccccagcaccacggccgaccagcagucccuguaccagaacgccgacgccuacgucuucgugggcaccagccgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggagcggcaucaucaucuccgacacccccguccacgacugcaacaccacgugccagaccccggagggcgccaucaacaccagccugcccuuccagaacauccaccccaucaccaucgggcggugccccaaguacgugaaguccacgaagcugcgccucgccaccggccugcggaacgugccgagcauccagucccgcgggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcggaucgagaaccugaacaagaagguggacgacggcuuccucgacaucuggaccuacaacgccgagcugcugguccuccuggagaacgagcgcacgcuggacuaccacgacuccaacgugaagaaccucuacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgagaagaucgacggcgugaagcucgagagcacccggaucuaccagauccuggccaucuacuccaccguggcgagcucccugguccucguggugagccugggggccaucagcuucuggaugugcuccaacggcagccugcagugccgcaucugcaucuga

SEQ ID NO: 73656 - RNA, 1701 nt, Artificial Sequence; identical to SEQ ID NO: 73063
  derived and/or modified sequence opt1 from hemagglutinin__InfluenzaA__AIL94595

SEQ ID NO: 73657 - RNA, 1701 nt, Artificial Sequence; identical to SEQ ID NO: 71002
  derived and/or modified sequence opt1 from hemagglutinin__InfluenzaA__AIL94606

SEQ ID NO: 73658 - RNA, 1701 nt, Artificial Sequence; identical to SEQ ID NO: 71048
  derived and/or modified sequence opt1 from hemagglutinin__InfluenzaA__AIL94618

SEQ ID NO: 73659 - RNA, 1701 nt, Artificial Sequence; identical to SEQ ID NO: 73595
  derived and/or modified sequence opt1 from hemagglutinin__InfluenzaA__AIL94629

SEQ ID NO: 73660 - RNA, 1701 nt, Artificial Sequence; identical to SEQ ID NO: 71002
  derived and/or modified sequence opt1 from hemagglutinin__InfluenzaA__AIL94640

SEQ ID NO: 73661 - RNA, 1701 nt, Artificial Sequence
  derived and/or modified sequence opt1 from hemagglutinin__InfluenzaA__AIL94652
augaaggccauccuggugguccuccuguacaccuucgccaccgcgaacgccgacacgcugugcaucggcuaccacgccaacaacagcaccgacaccguggacaccgugcucgagaagaacgucacggugacccacuccaucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagauguuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccacggccgaccagcagucccuguaccagaacgccgacgccuacgucuucgugggcaccagcaaguacuccaagaaguucaagcccgagaucgccauccggccgaaggugcgcgaccaggagggccggaugaacuacuacuggacccugaucgagcccggggacaagaucaccuucgaggcgacgggcaaccucgucgugccccgcuacgccuucgccauggagcggaacgccgggagcggcaucaucaucuccgacacccccgugcacgacugcaacacgaccugccagaccccggagggcgccaucaacaccagccugcccuuccagaacauccaccccaucaccaucgggaagugccccaaguacgucaaguccaccaagcugcgccucgcgacgggccugcggaacgugccgagcauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgucaagaaccucuacgagaaggugcggaaccagcugaagaacaacgccaaggagaucgggaacggcugcuucgaguucuaccacaagugcgacaacacgugcauggagagcgugaagaacgggaccuacgacuaccccaaguacuccgaggaggccaagcuggaccgcgagaagaucgacggcgucaagcucgagagcacccggaucuaccagauccuggcgaucuacuccaccguggccagcucccuggugcucgucgugagccugggggccaucagcuucuggaugugcuccaacggcagccugcagugccgcaucugcaucuga

SEQ ID NO: 73662 - RNA, 1701 nt, Artificial Sequence; identical to SEQ ID NO: 71048
  derived and/or modified sequence opt1 from hemagglutinin__InfluenzaA__AIL94663

SEQ ID NO: 73663 - RNA, 1701 nt, Artificial Sequence; identical to SEQ ID NO: 71048
  derived and/or modified sequence opt1 from hemagglutinin__InfluenzaA__AIL94674

SEQ ID NO: 73664 - RNA, 1701 nt, Artificial Sequence; identical to SEQ ID NO: 71002
  derived and/or modified sequence opt1 from hemagglutinin__InfluenzaA__AIL94697

SEQ ID NO: 73665 - RNA, 1701 nt, Artificial Sequence; identical to SEQ ID NO: 71048
  derived and/or modified sequence opt1 from hemagglutinin__InfluenzaA__AIL94709

SEQ ID NO: 73666 - RNA, 1701 nt, Artificial Sequence; identical to SEQ ID NO: 71048
  derived and/or modified sequence opt1 from hemagglutinin__InfluenzaA__AIL94720

SEQ ID NO: 73667 - RNA, 1701 nt, Artificial Sequence; identical to SEQ ID NO: 71002
  derived and/or modified sequence opt1 from hemagglutinin__InfluenzaA__AIL94731

SEQ ID NO: 73668 - RNA, 1701 nt, Artificial Sequence; identical to SEQ ID NO: 73595
  derived and/or modified sequence opt1 from hemagglutinin__InfluenzaA__AIL94743

SEQ ID NO: 73669 - RNA, 1701 nt, Artificial Sequence
  derived and/or modified sequence opt1 from hemagglutinin__InfluenzaA__AIL94754
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcugauccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgccaagaacgggaccuacgacuaccccaaguacuccgaggaggccaagcugaaccgggagaagaucgacggcgucaagcucgagagcacccgcaucuaccagauccuggcgaucuacuccaccguggccagcucccuggugcucgucgugagccugggggccaucagcuucuggaugugcuccaacggcagccugcagugccggaucugcaucuga

SEQ ID NO: 73670 - RNA, 1701 nt, Artificial Sequence; identical to SEQ ID NO: 73623
  derived and/or modified sequence opt1 from hemagglutinin__InfluenzaA__AIL94765

SEQ ID NO: 73671 - RNA, 1701 nt, Artificial Sequence; identical to SEQ ID NO: 71002
  derived and/or modified sequence opt1 from hemagglutinin__InfluenzaA__AIL94777

SEQ ID NO: 73672 - RNA, 1701 nt, Artificial Sequence; identical to SEQ ID NO: 72910
  derived and/or modified sequence opt1 from hemagglutinin__InfluenzaA__AIL94789

SEQ ID NO: 73673 - RNA, 1701 nt, Artificial Sequence; identical to SEQ ID NO: 71048
  derived and/or modified sequence opt1 from hemagglutinin__InfluenzaA__AIL94800

SEQ ID NO: 73674 - RNA, 1701 nt, Artificial Sequence
  derived and/or modified sequence opt1 from hemagglutinin__InfluenzaA__AIL94811
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcagaacacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73675 - RNA, 1701 nt, Artificial Sequence; identical to SEQ ID NO: 70866
  derived and/or modified sequence opt1 from hemagglutinin__InfluenzaA__AIL94823

SEQ ID NO: 73676 - RNA, 1701 nt, Artificial Sequence
  derived and/or modified sequence opt1 from hemagglutinin__InfluenzaA__AIL94835
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacuacagcaucggggagaucugcgacagcccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacccuggaguucaacaacgagagcuucaacugggccggggugacgcagaacggcaccuccagcgccugcauccggggguccaacagcuccuucuucagccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccggaucaccguguccaccaagcgcagccagcaggccgugaucccgaacaucggcagccggccccgcauccggaacauccccucccgcaucagcaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcucgccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccugaaguccacccaggccgccaucgaccagaucaacggcaagcugaaccgccucaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 73677 - RNA, 1701 nt, Artificial Sequence
  derived and/or modified sequence opt1 from hemagglutinin__InfluenzaA__AIL94847
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacgacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 73678 - RNA, 1701 nt, Artificial Sequence; identical to SEQ ID NO: 66541
  derived and/or modified sequence opt1 from hemagglutinin__InfluenzaA__AIL94859

SEQ ID NO: 73679 - RNA, 1701 nt, Artificial Sequence
  derived and/or modified sequence opt1 from hemagglutinin__InfluenzaA__AIL94871
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagagcacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaccaucuaccacaagugcgacaacgccugcaucgggagcauccgcaacggcaccuacgaccacaacgucuaccgggacgaggcccucaacaaccgcuuccagaucaaggggaucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 73680 - RNA, 1701 nt, Artificial Sequence; identical to SEQ ID NO: 73088
  derived and/or modified sequence opt1 from hemagglutinin__InfluenzaA__AIL94883

SEQ ID NO: 73681 - RNA, 1701 nt, Artificial Sequence; identical to SEQ ID NO: 73073
  derived and/or modified sequence opt1 from hemagglutinin__InfluenzaA__AIL94894

SEQ ID NO: 73682 - RNA, 1701 nt, Artificial Sequence; identical to SEQ ID NO: 70866
  derived and/or modified sequence opt1 from hemagglutinin__InfluenzaA__AIL94906

SEQ ID NO: 73683 - RNA, 1701 nt, Artificial Sequence; identical to SEQ ID NO: 71002
  derived and/or modified sequence opt1 from hemagglutinin__InfluenzaA__AIL94918

SEQ ID NO: 73684 - RNA, 1701 nt, Artificial Sequence; identical to SEQ ID NO: 71002
  derived and/or modified sequence opt1 from hemagglutinin__InfluenzaA__AIL94930

SEQ ID NO: 73685 - RNA, 1701 nt, Artificial Sequence; identical to SEQ ID NO: 71002
  derived and/or modified sequence opt1 from hemagglutinin__InfluenzaA__AIL94942

SEQ ID NO: 73686 - RNA, 1701 nt, Artificial Sequence; identical to SEQ ID NO: 71048
  derived and/or modified sequence opt1 from hemagglutinin__InfluenzaA__AIL94954

SEQ ID NO: 73687 - RNA, 1701 nt, Artificial Sequence; identical to SEQ ID NO: 70866
  derived and/or modified sequence opt1 from hemagglutinin__InfluenzaA__AIL94965

SEQ ID NO: 73688 - RNA, 1701 nt, Artificial Sequence
  derived and/or modified sequence opt1 from hemagglutinin__InfluenzaA__AIM55837
augaaggccauccuggugguccuccuguacaccuucgccaccgcgacggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcacgaccgccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugagccucgccaccggccugcggaacgucccguccauccagagccgcgggcuguucggcgcgaucgccggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgcggugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacagcaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgagaagaucgacggcgugaagcucgaguccacccggaucuaccagauccuggccaucuacagcaccgucgcguccagccuggugcucguggucagccugggggccaucuccuucuggaugugcagcaacggcucccugcagugccgcaucugcaucuga

SEQ ID NO: 73689 - RNA, 1701 nt, Artificial Sequence
  derived and/or modified sequence opt1 from hemagglutinin__InfluenzaA__AIM55848
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacaucccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacacggagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggccagcucccugguccucguggugagccugggggcgaucagcuucuggaugugcuccaacggcagccugcagugccggaucugcaucuga

SEQ ID NO: 73690 - RNA, 1701 nt, Artificial Sequence; identical to SEQ ID NO: 71048
  derived and/or modified sequence opt1 from hemagglutinin__InfluenzaA__AIM55859

SEQ ID NO: 73691 - RNA, 1701 nt, Artificial Sequence; identical to SEQ ID NO: 71048
  derived and/or modified sequence opt1 from hemagglutinin__InfluenzaA__AIM55870

SEQ ID NO: 73692 - RNA, 1701 nt, Artificial Sequence; identical to SEQ ID NO: 71048
  derived and/or modified sequence opt1 from hemagglutinin__InfluenzaA__AIM55881

SEQ ID NO: 73693 - RNA, 1701 nt, Artificial Sequence; identical to SEQ ID NO: 72910
  derived and/or modified sequence opt1 from hemagglutinin__InfluenzaA__AIM55893

SEQ ID NO: 73694 - RNA, 1701 nt, Artificial Sequence; identical to SEQ ID NO: 72029
  derived and/or modified sequence opt1 from hemagglutinin__InfluenzaA__AIM55904

SEQ ID NO: 73695 - RNA, 1701 nt, Artificial Sequence; identical to SEQ ID NO: 71048
  derived and/or modified sequence opt1 from hemagglutinin__InfluenzaA__AIM55915

SEQ ID NO: 73696 - RNA, 1710 nt, Artificial Sequence
  derived and/or modified sequence opt1 from hemagglutinin__InfluenzaA__AIM55926
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugacgucccugcccuuccagaacauccaccccaucaccaucgggaagugccccaaguacgucaagagcaccaagcuccggcuggccaccggccugcgcaacgugccguccauccagagccggggccucuucggcgccaucgcgggguucaucgagggcggcuggacggggaugguggacggcugguacggguaccaccaccagaacgagcagggcuccggguacgccgccgaccucaagagcacccagaacgccaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgcggagcugcucgugcugcuggagaacgagcggacccucgacuaccacgacagcaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggagaagaucgacggcgugaagcuggaguccacccgcaucuaccagauccuggccaucuacagcaccgucgccuccagccucgugcugguggucagccugggggcgaucuccuucuggaugugcagcaacggcucccuccagugccggaucugcaucuga

SEQ ID NO: 73697 - RNA, 1701 nt, Artificial Sequence; identical to SEQ ID NO: 71048
  derived and/or modified sequence opt1 from hemagglutinin__InfluenzaA__AIM55937

SEQ ID NO: 73698 - RNA, 1701 nt, Artificial Sequence; identical to SEQ ID NO: 72029
  derived and/or modified sequence opt1 from hemagglutinin__InfluenzaA__AIM55948

SEQ ID NO: 73699 - RNA, 1701 nt, Artificial Sequence; identical to SEQ ID NO: 72011
  derived and/or modified sequence opt1 from hemagglutinin__InfluenzaA__AIM55962

SEQ ID NO: 73700 - RNA, 1701 nt, Artificial Sequence; identical to SEQ ID NO: 72029
  derived and/or modified sequence opt1 from hemagglutinin__InfluenzaA__AIM55984

SEQ ID NO: 73701 - RNA, 1701 nt, Artificial Sequence; identical to SEQ ID NO: 72910
  derived and/or modified sequence opt1 from hemagglutinin__InfluenzaA__AIM55995

SEQ ID NO: 73702 - RNA, 1701 nt, Artificial Sequence
  derived and/or modified sequence opt1 from hemagglutinin__InfluenzaA__AIM56017
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggcacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 73703 - RNA, 1701 nt, Artificial Sequence; identical to SEQ ID NO: 73702
  derived and/or modified sequence opt1 from hemagglutinin__InfluenzaA__AIM56028

SEQ ID NO: 73704 - RNA, 1701 nt, Artificial Sequence
  derived and/or modified sequence opt1 from hemagglutinin__InfluenzaA__AIM56039
augaaggccauccuggugguccuccuguaccccuucgccaccgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgccccgcugcaccucgggaagugcaacaucgccggcuggauccuggggaaccccgagugcgagagccuguccaccgcgagcuccuggagcuacaucguggaggccuccagcuccgacaacgggaccugcuaccccggcgacuucaucaacuacgaggagcuccgggagcagcugagcuccgugagcuccuucgagcgcuucgagaucuuccccaagaccagcuccuggccgaaccacgacagcaacaagggcgucacggccgccugcccccacgcgggcgccaaguccuucuacaagaaccugaucuggcucgugaagaaggggaacagcuaccccaagcugucccagagcuacaucaacgacaagggcaaggaggugcugguccucugggggauccaccaccccagcaccaccgccgaccagcagucccuguaccagaacgccgacgccuacguguucgugggcaccagccgguacuccaagaaguucaagccggagaucgcgauccgccccaagguccgggaccaggagggccgcaugaacuacuacuggacgcugguggagcccggggacaagaucaccuucgaggccaccggcaaccucguggucccccgguacgccuucaccauggagcgcaacgccgggagcggcaucaucaucuccgacacgccggugcacgacugcaacacgaccugccagacccccgagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 73705 - RNA, 1701 nt, Artificial Sequence
  derived and/or modified sequence opt1 from hemagglutinin__InfluenzaA__AIM56050
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccggggcaagaucgacggggugaagcucgagagcacccgcaucuaccagauccuggccaucuacuccaccgucgccagcucccuggugcucguggucagccugggcgcgaucagcuucuggaugugcuccaacggcagccugcagugccggaucugcaucuga

SEQ ID NO: 73706 - RNA, 1701 nt, Artificial Sequence; identical to SEQ ID NO: 71048
  derived and/or modified sequence opt1 from hemagglutinin__InfluenzaA__AIM56061

SEQ ID NO: 73707 - RNA, 1701 nt, Artificial Sequence; identical to SEQ ID NO: 71048
  derived and/or modified sequence opt1 from hemagglutinin__InfluenzaA__AIM56072

SEQ ID NO: 73708 - RNA, 1701 nt, Artificial Sequence; identical to SEQ ID NO: 72901
  derived and/or modified sequence opt1 from hemagglutinin__InfluenzaA__AIM56083

SEQ ID NO: 73709 - RNA, 1701 nt, Artificial Sequence; identical to SEQ ID NO: 71048
  derived and/or modified sequence opt1 from hemagglutinin__InfluenzaA__AIM56105

SEQ ID NO: 73710 - RNA, 1701 nt, Artificial Sequence; identical to SEQ ID NO: 71048
  derived and/or modified sequence opt1 from hemagglutinin__InfluenzaA__AIM56116

SEQ ID NO: 73711 - RNA, 1701 nt, Artificial Sequence
  derived and/or modified sequence opt1 from hemagglutinin__InfluenzaA__AIM56127
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaaggccagcuccuggcccaaccacgacagcaacaagggggucaccgccgccugcccgcacgcgggcgccaaguccuucuacaagaaccugaucuggcucgugaagaaggggaacagcuaccccaagcugucccagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgcgauccgcccgaagguccgggaccaggagggccgcaugaacuacuacuggacccugguggagcccggggacaagaucaccuucgaggccaccggcaaccucguggucccccgguacgccuucacgauggagcgcaacgccgggagcggcaucaucaucuccgacacccccgugcacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacaucccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 73712 - RNA, 1701 nt, Artificial Sequence; identical to SEQ ID NO: 71048
  derived and/or modified sequence opt1 from hemagglutinin__InfluenzaA__AIM56138

SEQ ID NO: 73713 - RNA, 1701 nt, Artificial Sequence; identical to SEQ ID NO: 71048
  derived and/or modified sequence opt1 from hemagglutinin__InfluenzaA__AIM56149

SEQ ID NO: 73714 - RNA, 1701 nt, Artificial Sequence; identical to SEQ ID NO: 72901
  derived and/or modified sequence opt1 from hemagglutinin__InfluenzaA__AIM56160

SEQ ID NO: 73715 - RNA, 1701 nt, Artificial Sequence; identical to SEQ ID NO: 71048
  derived and/or modified sequence opt1 from hemagglutinin__InfluenzaA__AIM56171

SEQ ID NO: 73716 - RNA, 1701 nt, Artificial Sequence
  derived and/or modified sequence opt1 from hemagglutinin__InfluenzaA__AIM56182
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaaggccagcuccuggcccaaccacgacagcaacaagggggucaccgccgccugcccgcacgcgggcgccaaguccuucuacaagaaccugaucuggcucgugaagaaggggaacagcuaccccaagcugucccagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgcgauccgcccgaagguccgggaccaggagggccgcaugaacuacuacuggacccugguggagcccggggacaagaucaccuucgaggccaccggcaaccucguggucccccgguacgccuucacgauggagcgcaacgccgggagcggcaucaucaucuccgacacccccgugcacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacaucccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaacaaggagaagaucgacggcgugaagcucgagagcacccggaucuaccagauccuggcgaucuacuccaccguggccagcucccugguccucguggugagccugggggccaucagcuucuggaugugcuccaacggcagccugcagugccgcaucugcaucuga

SEQ ID NO: 73717 - RNA, 1701 nt, Artificial Sequence
  derived and/or modified sequence opt1 from hemagglutinin__InfluenzaA__AIM56193
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaaggugaccuucgaggcgacgggcaaccucgucgugccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgucaaguccacgaagcugcggcucgccaccggccugcgcaacgugccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgucaagcucgagagcacccgcaucuaccagauccuggccaucuacuccaccguggcgagcucccuggugcucgucgugagccugggggccaucagcuucuggaugugcuccaacggcagccugcagugccggaucugcaucuga

SEQ ID NO: 73718 - RNA, 1701 nt, Artificial Sequence; identical to SEQ ID NO: 71048
  derived and/or modified sequence opt1 from hemagglutinin__InfluenzaA__AIM56204

SEQ ID NO: 73719 - RNA, 1701 nt, Artificial Sequence; identical to SEQ ID NO: 71048
  derived and/or modified sequence opt1 from hemagglutinin__InfluenzaA__AIM56215

SEQ ID NO: 73720 - RNA, 1701 nt, Artificial Sequence; identical to SEQ ID NO: 71048
  derived and/or modified sequence opt1 from hemagglutinin__InfluenzaA__AIM56226

SEQ ID NO: 73721 - RNA, 1701 nt, Artificial Sequence; identical to SEQ ID NO: 73459
  derived and/or modified sequence opt1 from hemagglutinin__InfluenzaA__AIM56237

SEQ ID NO: 73722 - RNA, 1701 nt, Artificial Sequence; identical to SEQ ID NO: 71048
  derived and/or modified sequence opt1 from hemagglutinin__InfluenzaA__AIM56259

SEQ ID NO: 73723 - RNA, 1701 nt, Artificial Sequence
  derived and/or modified sequence opt1 from hemagglutinin__InfluenzaA__AIM56270
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccgugaacaccagccugcccuuccagaacauccaccccaucaccaucgggaagugccccaaguacgucaaguccacgaagcugcggcucgccaccggccugcgcaacgugccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgucaagcucgagagcacccgcaucuaccagauccuggccaucuacuccaccguggcgagcucccuggugcucgucgugagccugggggccaucagcuucuggaugugcuccaacggcagccugcagugccggaucugcaucuga

SEQ ID NO: 73724 - RNA, 1701 nt, Artificial Sequence; identical to SEQ ID NO: 71048
  derived and/or modified sequence opt1 from hemagglutinin__InfluenzaA__AIM56281

SEQ ID NO: 73725 - RNA, 1701 nt, Artificial Sequence
  derived and/or modified sequence opt1 from hemagglutinin__InfluenzaA__AIM56292
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucaacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcugucccagagcuacaucaacgacaagggcaaggagauccucgugcugugggggauccaccaccccagcaccacggccgaccagcagucccuguaccagaacgccgacgccuacgucuucgugggcaccagccgguacuccaagaaguucaagcccgagaucgccauccgcccgaaggugcgggaccaggagggccgcaugaacuacuacuggacccucgucgagcccggggacaagaucaccuucgaggcgacgggcaaccugguggugccccgguacgccuucaccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcuccggcuggccaccggccugcgcaacgugccgagcauccagucccggggccucuucggggcgaucgccggguucaucgagggcggcuggaccgggauggucgacggcugguacggguaccaccaccagaacgagcagggcagcggguacgccgccgaccugaaguccacccagaacgccaucgacaagaucacgaacaaggugaacagcgugaucgagaagaugaacacccaguucaccgcggucggcaaggaguucaaccaccuggagaagcgcaucgagaaccucaacaagaagguggacgacggcuuccuggacaucuggaccuacaacgccgagcugcucguccugcuggagaacgagcggacgcucgacuaccacgacuccaacgugaagaaccuguacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggagaagaucgacggcgugaagcuggagagcacccgcaucuaccagauccuggccaucuacuccaccguggcgagcucccucguccugguggugagccugggggccaucagcuucuggaugugcuccaacggcagccuccagugccggaucugcaucuga

SEQ ID NO: 73726 - RNA, 1701 nt, Artificial Sequence
  derived and/or modified sequence opt1 from hemagglutinin__InfluenzaA__AIM56303
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucaacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcugucccagagcuacaucaacgacaagggcaaggaggugcucguccugugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccucguggagcccggggacaagaucaccuucgaggcgacgggcaaccugguggucccccgguacgccuucaccauggagcgcaacgccgggagcggcaucaucaucuccgacacccaggugcacgacugcaacaccacgugccagacccccgagggcgccaucaacaccagccugccguuccagaacauccaccccaucaccaucgggaagugccccaaguacgugaaguccacgaagcuccggcuggccaccggccugcgcaacguccccagcauccagucccggggccucuucggggcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacagcgucaucgagaagaugaacacccaguucaccgcggugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggagaagaucgacggcgugaagcuggagagcacccgcaucuaccagauccuggccaucuacuccaccgucgcgagcucccucgugcugguggucagccugggggccaucagcuucuggaugugcuccaacggcagccuccagugccggaucugcaucuga

SEQ ID NO: 73727 - RNA, 1701 nt, Artificial Sequence
  derived and/or modified sequence opt1 from hemagglutinin__InfluenzaA__AIM56314
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaagcucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73728 - RNA, 1701 nt, Artificial Sequence; identical to SEQ ID NO: 71048
  derived and/or modified sequence opt1 from hemagglutinin__InfluenzaA__AIM56325

SEQ ID NO: 73729 - RNA, 1701 nt, Artificial Sequence
  derived and/or modified sequence opt1 from hemagglutinin__InfluenzaA__AIM56336
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacaucccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaagauccgcaaccagcugaagaacaacgccaaggagaucgggaacggcugcuucgaguucuaccacaagugcgacaacaugugcauggagagcgugaagaacgggaccuacgacuaccccaaguacuccgaggaggccaagcugaaccgggagaagaucgacggcgucaagcucgagagcacccgcaucuaccagauccuggccaucuacuccaccguggcgagcucccuggugcucgucgugagccugggggccaucagcuucuggaugugcuccaacggcagccugcagugccggaucugcaucuga

SEQ ID NO: 73730 - RNA, 1701 nt, Artificial Sequence
  derived and/or modified sequence opt1 from hemagglutinin__InfluenzaA__AIM56347
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccaccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 73731 - RNA, 1701 nt, Artificial Sequence
  derived and/or modified sequence opt1 from hemagglutinin__InfluenzaA__AIM56358
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccuggugaagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73732 - RNA, 1701 nt, Artificial Sequence; identical to SEQ ID NO: 71048
  derived and/or modified sequence opt1 from hemagglutinin__InfluenzaA__AIM56369

SEQ ID NO: 73733 - RNA, 1701 nt, Artificial Sequence
  derived and/or modified sequence opt1 from hemagglutinin__InfluenzaA__AIM56380
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugagccgggagaagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 73734 - RNA, 1701 nt, Artificial Sequence; identical to SEQ ID NO: 71048
  derived and/or modified sequence opt1 from hemagglutinin__InfluenzaA__AIM56391

SEQ ID NO: 73735 - RNA, 1701 nt, Artificial Sequence; identical to SEQ ID NO: 71048
  derived and/or modified sequence opt1 from hemagglutinin__InfluenzaA__AIM56402

SEQ ID NO: 73736 - RNA, 1701 nt, Artificial Sequence; identical to SEQ ID NO: 72901
  derived and/or modified sequence opt1 from hemagglutinin__InfluenzaA__AIM56413

SEQ ID NO: 73737 - RNA, 1701 nt, Artificial Sequence; identical to SEQ ID NO: 71048
  derived and/or modified sequence opt1 from hemagglutinin__InfluenzaA__AIM56425

SEQ ID NO: 73738 - RNA, 1701 nt, Artificial Sequence; identical to SEQ ID NO: 71048
  derived and/or modified sequence opt1 from hemagglutinin__InfluenzaA__AIM56436

SEQ ID NO: 73739 - RNA, 1701 nt, Artificial Sequence; identical to SEQ ID NO: 71048
  derived and/or modified sequence opt1 from hemagglutinin__InfluenzaA__AIM56447

SEQ ID NO: 73740 - RNA, 1701 nt, Artificial Sequence; identical to SEQ ID NO: 71048
  derived and/or modified sequence opt1 from hemagglutinin__InfluenzaA__AIM56469

SEQ ID NO: 73741 - RNA, 1701 nt, Artificial Sequence
  derived and/or modified sequence opt1 from hemagglutinin__InfluenzaA__AIM56480
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccagccugcccuuccagaacauccaccccaucacgcuggggaagugccccaaguacgugaaguccaccaagcuccggcuggccaccggccugcgcaacgucccgagcauccagucccggggccucuucggcgccaucgcgggguucaucgagggcggcuggaccgggaugguggacggcugguacggguaccaccaccagaacgagcagggcagcggguacgccgccgaccugaaguccacgcagaacgccaucgacaagaucaccaacaaggugaacagcgucaucgagaagaugaacacccaguucaccgccgugggcaaggaguucaaccaccuggagaagcgcaucgagaaccucaacaagaaggucgacgacggcuuccuggacaucuggacguacaacgcggagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagagcacccgcaucuaccagauccuggccaucuacuccaccgucgccagcucccucgugcugguggucagccugggggcgaucagcuucuggaugugcuccaacggcagccuccagugccggaucugcaucuga

SEQ ID NO: 73742 - RNA, 1701 nt, Artificial Sequence; identical to SEQ ID NO: 71048
  derived and/or modified sequence opt1 from hemagglutinin__InfluenzaA__AIM56491

SEQ ID NO: 73743 - RNA, 1710 nt, Artificial Sequence
  derived and/or modified sequence opt1 from hemagglutinin__InfluenzaA__AIM56502
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaaggccagcuccuggcccaaccacgacagcaacaagggggucaccgccgccugcccgcacgcgggcgccaaguccuucuacaagaaccugaucuggcucgugaagaaggggaacagcuaccccaagcugucccagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgcgauccgcccgaagguccgggaccaggagggccgcaugaacuacuacuggacccugguggagcccggggacaagaucaccuucgaggccaccggcaaccucguggucccccgguacgccuucacgauggagcgcaacgccgggagcggcaucaucaucuccgacacccccgugcacgacugcaacacgaccugccagaccccggagggcgccaucaacaccagccugaccucccugcccuuccagaacauccaccccaucaccaucgggaagugccccaaguacgucaagagcacgaagcuccggcuggcgaccggccugcgcaacaucccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucacgaacaaggugaacuccgugaucgagaagaugaacacccaguucaccgccgucggcaaggaguucaaccaccuggagaagcgcaucgagaaccucaacaagaagguggacgacggcuuccuggacaucuggaccuacaacgccgagcugcucguccugcuggagaacgagcggacgcucgacuaccacgacagcaacgugaagaaccuguacgagaaggugcgcaaccagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgggagaagaucgacggcgugaagcuggaguccacccgcaucuaccagauccuggcgaucuacagcaccguggccuccagccucguccugguggugagccugggggccaucuccuucuggaugugcagcaacggcucccuccagugccggaucugcaucuga

SEQ ID NO: 73744 - RNA, 1701 nt, Artificial Sequence; identical to SEQ ID NO: 71048
  derived and/or modified sequence opt1 from hemagglutinin__InfluenzaA__AIM56513

SEQ ID NO: 73745 - RNA, 1701 nt, Artificial Sequence; identical to SEQ ID NO: 72993
  derived and/or modified sequence opt1 from hemagglutinin__InfluenzaA__AIM56524

SEQ ID NO: 73746 - RNA, 1701 nt, Artificial Sequence; identical to SEQ ID NO: 71048
  derived and/or modified sequence opt1 from hemagglutinin__InfluenzaA__AIM56535

SEQ ID NO: 73747 - RNA, 1701 nt, Artificial Sequence; identical to SEQ ID NO: 71048
  derived and/or modified sequence opt1 from hemagglutinin__InfluenzaA__AIM56546

SEQ ID NO: 73748 - RNA, 1701 nt, Artificial Sequence; identical to SEQ ID NO: 72901
  derived and/or modified sequence opt1 from hemagglutinin__InfluenzaA__AIM56557

SEQ ID NO: 73749 - RNA, 1701 nt, Artificial Sequence
  derived and/or modified sequence opt1 from hemagglutinin__InfluenzaA__AIM56568
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccuucgagcgcuucgagaucuucagcaagaccuccagcuggcccaaccacgacuccaacaagggggucaccgccgccugcccccacgccggcgccaagagcuucuacaagaaccugaucuggcucgugaagaaggggaacuccuacccgaagcugagccagagcuacaucaacgacaagggcaaggaggugcugguccucugggggauccaccaccccuccaccacggccgaccagcagagccuguaccagaacgccgacgccuacguguucgugggcaccucccgguacagcaagaaguucaagcccgagaucgccauccgccccaagguccgggaccaggagggccgcaugaacuacuacuggacccugguggagccgggggacaagaucaccuucgaggcgacgggcaaccucguggucccccgguacgccuucaccauggagcgcaacgccggguccggcaucaucaucagcgacacccccgugcacgacugcaacaccacgugccagacccccgagggcgccaucaacaccucccugccguuccagaacauccaccccaucaccaucgggaagugccccaaguacgucaagagcacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggagaagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 73750 - RNA, 1701 nt, Artificial Sequence
  derived and/or modified sequence opt1 from hemagglutinin__InfluenzaA__AIM56579
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacgagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugucccagagcuacaucaacgacaagggcaaggaggugcugguccucugggggauccaccaccccagcacgaccgcggaccagcagucccuguaccagaacaccgacgccuacguguucgugggcaccagccgguacuccaagaaguucaagcccgagaucgccauccgcccgaagguccgggaccaggagggccgcaugagcuacuacuggacgcugguggagcccggggacaagaucaccuucgaggccaccggcaaccucguggucccccgguacgccuucaccauggagcgcaacgcgggguccggcaucaucaucagcgacacgcccgugcacgacugcaacacgaccugccagaccccggagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgcggccgaccucaagagcacccagaacgccaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgcgaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgccuccagccuggugcucguggucagccugggggccaucuccuucuggaugugcagcaacggcucccugcagugccggaucugcaucuga

SEQ ID NO: 73751 - RNA, 1710 nt, Artificial Sequence
  derived and/or modified sequence opt1 from hemagglutinin__InfluenzaA__AIM56590
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugaccucccugcccuuccagaacauccaccccaucacgaucgggaagugccccaaguacgucaagagcaccaagcuccggcuggccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacagcaacgugaagaaccuguacgagaagguccgcaaccagcugaagaacaacgccaaggagaucgggaacggcugcuucgaguucuaccacaagugcgacgacacgugcauggaguccgugaagaacgggaccuacgacuaccccaaguacagcgaggaggccaagcucaaccgggagaagaucgacggcgugaagcuggaguccacccgcaucuaccagauccuggccaucuacagcaccgucgcguccagccucgugcugguggucagccugggggccaucuccuucuggaugugcagcaacggcucccuccagugccggaucugcaucuga

SEQ ID NO: 73752 - RNA, 1710 nt, Artificial Sequence
  derived and/or modified sequence opt1 from hemagglutinin__InfluenzaA__AIM56601
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugaccucccugcccuuccagaacauccaccccaucacgaucgggaagugccccaaguacgucaagagcaccaagcuccggcuggccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacagcaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggagaagaucgacggcgugaagcuggaguccacccgcaucuaccagauccuggccaucuacagcaccgucgcguccagccucgugcugguggucagccugggggccaucuccuucuggaugugcagcaacggcucccuccagugccggaucugcaucuga

SEQ ID NO: 73753 - RNA, 1710 nt, Artificial Sequence
  derived and/or modified sequence opt1 from hemagglutinin__InfluenzaA__AIM56612
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacaccgggagcggcaucaucaucuccgacacccccgugcacgacugcaacacgaccugccagaccccggagggcgccaucaacaccagccugacgucccugcccuuccagaacauccaccccaucaccaucgggaagugccccaaguacgucaagagcaccaagcuccggcuggccaccggccugcgcaacgugccguccauccagagccgggggcuguucggcgccaucgcgggguucaucgagggcggcuggacggggaugguggacggcugguacggguaccaccaccagaacgagcagggcuccggguacgccgccgaccucaagagcacccagaacgccaucgacaagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgcggagcugcucgugcugcuggagaacgagcggacccucgacuaccacgacagcaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggagaagaucgacggcgugaagcuggaguccacccgcaucuaccagauccuggccaucuacagcaccgucgccuccagccucgugcugguggucagccugggggcgaucuccuucuggaugugcagcaacggcucccuccagugccggaucugcaucuga

SEQ ID NO: 73754 - RNA, 1701 nt, Artificial Sequence
  derived and/or modified sequence opt1 from hemagglutinin__InfluenzaA__AIM56623
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaccuggcucgugaagaaggggaacagcuaccccaagcugucccagagcuacaucaacgacaagggcaaggaggugcugguccucugggggauccaccaccccagcacgaccgccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73755 - RNA, 1701 nt, Artificial Sequence
  derived and/or modified sequence opt1 from hemagglutinin__InfluenzaA__AIM56634
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaacagcugguccuacaucguggagaccagcuccagcgacaacggcacgugcuaccccggcgacuucaucaacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagccaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucagcgacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 73756 - RNA, 1710 nt, Artificial Sequence
  derived and/or modified sequence opt1 from hemagglutinin__InfluenzaA__AIM56645
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugaccucccugcccuuccagaacauccaccccaucacgaucgggaagugccccaaguacgucaagagcaccaagcuccggcuggccaccggccugcgcaacgugccguccauccagagccggggccucuucggggcgaucgccggguucaucgagggcggcuggaccgggaugguggacggcugguacggguaccaccaccagaacgagcagggcuccggguacgccgccgaccagaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 73757 - RNA, 1701 nt, Artificial Sequence
  derived and/or modified sequence opt1 from hemagglutinin__InfluenzaA__AIM56656
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccaacagcuggcccaaccacgacuccaacaagggggucaccgccgccugcccgcacgccggcgccaagagcuucuacaagaaccugaucuggcucgugaagaaggggaacuccuaccccaagcugagccaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaacaucguggucccccgguacgccuucaccauggagcgcaacgccggguccggcaucaucaucagcgacacccccgugcacgacugcaacaccacgugccagaccccggagggcgccaucaacaccucccuccccuuccagaacauccaccccaucaccaucgggaagugccccaaguacgucaagagcacgaagcugcggcuggccaccggccuccgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcuggaguccacccgcaucuaccagauccucgccaucuacagcaccgucgcguccagccuggugcugguggucucccucggggccaucagcuucuggaugugcagcaacggcucccugcagugccggaucugcaucuga

SEQ ID NO: 73758 - RNA, 1701 nt, Artificial Sequence; identical to SEQ ID NO: 71048
  derived and/or modified sequence opt1 from hemagglutinin__InfluenzaA__AIM56667

SEQ ID NO: 73759 - RNA, 1701 nt, Artificial Sequence
  derived and/or modified sequence opt1 from hemagglutinin__InfluenzaA__AIM56678
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgugcccccgcugcaccucgggaagugcaacaucgccggcuggauccuggggaaccccgagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggccgaaccacgacagcaacaagggggucaccgcggccugcccccacgccggcgccaaguccuucuacaagaaccugaucuggcucgugaagaaggggaacagcuaccccaagcugucccagagcuacaucaacgacaagggcaaggaggugcugguccucugggggauccaccaccccagcaccacggcggaccagcagucccuguaccagaacgccgacgccuacguguucgugggcaccagccgguacuccaagaaguucaagccggagaucgccauccgccccaagguccgggaccaggagggccgcaugaacuacuacuggacccugguggagcccggggacaagaucaccuucgaggccacgggcaaccucguggucccccgguacgcguucaccauggagcgcaacgccgggagcggcaucaucaucuccgacaccccggugcacgacugcaacaccacgugccagacccccgagggcgccaucaacaccagccugcccuuccagaacauccaccccaucaccaucgggaagugcccgaaguacgugaaguccacgaagcugcggcucgccaccggccugcgcaacguccccagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 73760 - RNA, 1701 nt, Artificial Sequence; identical to SEQ ID NO: 73396
  derived and/or modified sequence opt1 from hemagglutinin__InfluenzaA__AIM56689

SEQ ID NO: 73761 - RNA, 1701 nt, Artificial Sequence; identical to SEQ ID NO: 71048
  derived and/or modified sequence opt1 from hemagglutinin__InfluenzaA__AIM56700

SEQ ID NO: 73762 - RNA, 1710 nt, Artificial Sequence
  derived and/or modified sequence opt1 from hemagglutinin__InfluenzaA__AIM56711
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgugcccccgcugcaccucgggaagugcaacaucgccggcuggauccuggggaaccccgagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggccgaaccacgacagcaacaagggggucaccgcggccugcccccacgccggcgccaaguccuucuacaagaaccugaucuggcucgugaagaaggggaacagcuaccccaagcugucccagagcuacaucaacgacaagggcaaggaggugcugguccucugggggauccaccaccccagcaccacggcggaccagcagucccuguaccagaacgccgacgccuacguguucgugggcaccagccgguacuccaagaaguucaagccggagaucgccauccgccccaagguccgggaccaggagggccgcaugaacuacuacuggacccugguggagcccggggacaagaucaccuucgaggccacgggcaaccucguggucccccgguacgcguucaccauggagcgcaacgccgggagcggcaucaucaucuccgacaccccggugcacgacugcaacaccacgugccagacccccgagggcgccaucaacaccagccugaccucccugcccuuccagaacauccaccccaucacgaucgggaagugcccgaaguacgucaagagcaccaagcuccggcuggccaccggccugcgcaacguccccuccauccagagccgggggcuguucggcgccaucgcgggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgccgugggcaaggaguucaaccaccuggagaagcgcaucgagaaccucaacaagaaggucgacgacggcuuccuggacaucuggacguacaacgcggagcugcucgugcugcuggagaacgagcggacccucgacuaccacgacagcaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggagaagaucgacggcgugaagcuggaguccacccgcaucuaccagauccuggccaucuacagcaccgucgccuccagccucgugcugguggucagccugggggcgaucuccuucuggaugugcagcaacggcucccuccagugccggaucugcaucuga

SEQ ID NO: 73763 - RNA, 1701 nt, Artificial Sequence; identical to SEQ ID NO: 73396
  derived and/or modified sequence opt1 from hemagglutinin__InfluenzaA__AIM56722

SEQ ID NO: 73764 - RNA, 1701 nt, Artificial Sequence; identical to SEQ ID NO: 71048
  derived and/or modified sequence opt1 from hemagglutinin__InfluenzaA__AIM56733

SEQ ID NO: 73765 - RNA, 1701 nt, Artificial Sequence; identical to SEQ ID NO: 71048
  derived and/or modified sequence opt1 from hemagglutinin__InfluenzaA__AIM56744

SEQ ID NO: 73766 - RNA, 1701 nt, Artificial Sequence
  derived and/or modified sequence opt1 from hemagglutinin__InfluenzaA__AIM56755
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccagccacgacuccaacaagggggucaccgccgccugcccgcacgccggcgccaagagcuucuacaagaaccugaucuggcucgugaagaaggggaacuccuaccccaagcugagccagagcuacaucaacgacaagggcaaggaggugcugguccucugggggauccaccaccccuccaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucagcgacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 73767 - RNA, 1710 nt, Artificial Sequence; identical to SEQ ID NO: 73752
  derived and/or modified sequence opt1 from hemagglutinin__InfluenzaA__AIM56766

SEQ ID NO: 73768 - RNA, 1701 nt, Artificial Sequence
  derived and/or modified sequence opt1 from hemagglutinin__InfluenzaA__AIM56777
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcugucccagagcuacaucaacgacaaggggaaggaggugcugguccucuggggcauccaccaccccagcaccacggccgaccagcagucccuguaccagaacgccgacgccuacguguucgugggcaccagccgguacuccaagaaguucaagcccgagaucgccauccgcccgaagguccgggaccaggaggggcgcaugaacuacuacuggacccugguggagcccggcgacaagaucaccuucgaggcgacggggaaccucguggucccccgguacgccuucaccauggagcgcaacgccggcagcggcaucaucaucuccgacacccccgugcacgacugcaacaccacgugccagaccccggagggggccaucaacaccagccugcccuaccagaacauccaccccaucaccaucggcaagugccccaaguacgugaaguccacgaagcugcggcucgccaccgggcugcgcaacgucccgagcauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggagaagaucgacggggugaagcucgagagcacccgcaucuaccagauccuggccaucuacuccaccgucgcgagcucccuggugcucguggucagccugggcgccaucagcuucuggaugugcuccaacggcagccugcagugccggaucugcaucuga

SEQ ID NO: 73769 - RNA, 1701 nt, Artificial Sequence; identical to SEQ ID NO: 71048
  derived and/or modified sequence opt1 from hemagglutinin__InfluenzaA__AIM56788

SEQ ID NO: 73770 - RNA, 1701 nt, Artificial Sequence; identical to SEQ ID NO: 71048
  derived and/or modified sequence opt1 from hemagglutinin__InfluenzaA__AIM56799

SEQ ID NO: 73771 - RNA, 1701 nt, Artificial Sequence; identical to SEQ ID NO: 71048
  derived and/or modified sequence opt1 from hemagglutinin__InfluenzaA__AIM56810

SEQ ID NO: 73772 - RNA, 1701 nt, Artificial Sequence; identical to SEQ ID NO: 71048
  derived and/or modified sequence opt1 from hemagglutinin__InfluenzaA__AIM56821

SEQ ID NO: 73773 - RNA, 1683 nt, Artificial Sequence
  derived and/or modified sequence opt1 from hemagglutinin__InfluenzaA__AIN76383
augaacacccagauccugguguucgcccucaucgccaucguccccaccaacgcggacaagaucugccugggccaccacgccgugagcaacgggacgaaggugaacacccugaccgagcgcggcgucgagguggugaacgccaccgagacggucgagcggaccaacaucccgcgcaucugcuccaaggggaagaagaccguggaccucggccagugcgggcugcugggcaccaucacgggcccgccccagugcgaccaguuccucgaguucagcgccgaccugaucaucgagcggcgcgagggguccgacgugugcuaccccggcaaguucgucaacgaggaggcccugcggcagauccuccgcgagagcgggggcaucgacaaggaggcgaugggguucaccuacuccggcauccggaccaacggcaccacgagcgccugccgccgguccgggagcuccuucuacgccgagaugaaguggcugcugagcaacaccgacaacgccgcguucccccagaugaccaaguccuacaagaacacccgcaagagccccgcccucaucguguggggcauccaccacuccgugagcacggccgagcagaccaagcuguacggguccggcaacaagcuggucaccgugggcagcuccaacuaccagcagagcuucgugcccucccccggggcccggccgcaggucaacggccucagcgggcgcaucgacuuccacuggcugaugcugaaccccaacgacaccgugacguucagcuucaacggcgccuucaucgcgcccgaccgggccuccuuccuccgcggcaagagcauggggauccaguccggcgugcaggucgacgccaacugcgagggggacugcuaccacagcggcgggaccaucaucuccaaccugcccuuccagaacaucgacagccgggccgugggcaagugcccgcgcuacgugaagcagaagucccugcuccuggccaccgggaugaagaacguccccgagauccccaagggccggggccuguucggggcgaucgccggcuucaucgagaacgggugggagggccucaucgacgggugguacggcuuccgccaccagaacgcccagggcgaggggaccgccgccgacuacaagagcacgcaguccgcgaucgaccagaucaccggcaagcugaaccggcugaucgagaagaccaaccagcaguucgagcucaucgacaacgaguucaacgagguggagaagcagaucgggaacgugaucaacuggacccgcgacagcaucacggaggucugguccuacaacgccgagcugcugguggccauggagaaccagcacaccaucgaccucgccgacagcgagauggacaagcuguacgagcgggucaagcgccagcugcgcgagaacgccgaggaggacggcaccggcugcuucgagaucuuccacaagugcgacgacgacugcauggcguccauccggaacaacaccuacgaccacagcaaguaccgcgaggaggccaugcagaaccggauccagaucgaccccgugaagcucuccagcggguacaaggacgugauccugugguucuccuucggcgccagcugcuucauccugcucgccaucgucauggggcugguguucaucugcgugaagaacggcaacaugcgcugcacgaucugcaucuga

SEQ ID NO: 73774 - RNA, 1689 nt, Artificial Sequence
  derived and/or modified sequence opt1 from hemagglutinin__InfluenzaA__AIP93103
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagcuucaacgacuacgaggagcugaagcaccuccuguccagcgugaagcacuucgagaaggugaagauccugcccaaggacggguggacgcagcacgagaccgacggcggguccaaggccugcgccgucagcggcaagcccuccuucuuccggaacaugguguggcugaccaagaaggggcccaacuacccgguggcgaagcgcagcuacaacaacaccuccggcgagcagaugcucaucaucuggggcguccaccaccccaacgacgaggccgagcagcgggcccuguaccagaacguggggacguacgugagcgccuccaccagcacccugaacaagcgcuccacccccgagaucgcggcccggcccaaggucagcggccucgggucccgcauggaguucagcuggacgcugcuggacgugugggacaccaucuccuucgagagcaccggcaaccucguggccccggaguacggcuucaagaucagcaagcggggguccagcggcaucaugaagaccgaggggacgcugggcaacugcgagaccaagugccagacgccccugggggccaucaacaccacccuccccuuccacaacguccacccccugaccaucggcgagugcccgaaguacgugaaguccgagaagcuggugcucgccaccggcccccgcaacgucccccagaucgagagccgggggcuguucggcgcgaucgccggguucaucgagggcggguggcagggcaugguggacggcugguacggguaccaccacuccaacgaccagggcagcggguacgccgccgacaaggaguccacccagaaggccuucgaccgcaucacgaacaaggugaacagcgucaucgagaagaugaacacccaguucgaggcggugggcaaggaguucuccaaccuggagaagcggcucgagaaccugaacaagaagauggaggacggguuccuggacguguggaccuacaacgccgagcuccugguccugauggagaacgagcgcacccucgacuuccacgacagcaacgugaagaaccuguacgacaagguccggaugcagcugcgcgacaacgugaaggagcucggcaacggcugcuucgaguucuaccacaagugcgacgacgagugcaugaacuccgugaagaacgggacguacgacuaccccaaguacgaggaggagagcaagcugaagcggaacgagaucaagggcgucaagcuguccagcauggggguguaccagauccucgccaucuacgccaccguggccggcucccugagccuggcgaucaugaucgccggcaucuccuucuggaugugcagcaacgggucccuccagugccgcaucugcaucuga

SEQ ID NO: 73775 - RNA, 1689 nt, Artificial Sequence; identical to SEQ ID NO: 62663
  derived and/or modified sequence opt1 from hemagglutinin__InfluenzaA__AIP93115

SEQ ID NO: 73776 - RNA, 1701 nt, Artificial Sequence
  derived and/or modified sequence opt1 from hemagglutinin__InfluenzaA__AIR93971
augaaggccauccuggugguccuccuguacaccuucgccaccacgaacgcggacauccugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcccgguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacgucccgcuacagcaagaaguucaagcccgagaucgccauccggccgaagguccgcgaccgggagggccgcaugaacuacuacuggacccugguggagcccggggacaagaucaccuucgaggccaccggcaaccucguggucccccgguacgcguucgccauggagcgcaacgccggguccggcaucaucacgagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 73777 - RNA, 1701 nt, Artificial Sequence
  derived and/or modified sequence opt1 from hemagglutinin__InfluenzaA__AIR93982
augaaggccauccuggugguccuccuguacaccaucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgcgguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccgggagggccgcaugaacuacuacuggacccugguggagcccggggacaagaucaccuucgaggcgaccggcaaccucguggucccccgguacgccuucacgauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagacgaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 73778 - RNA, 1701 nt, Artificial Sequence
  derived and/or modified sequence opt1 from hemagglutinin__InfluenzaA__AIR93993
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcggcagccuguccaccgccagcuccuggagcuacaucguggagaccuccagcuccgacaacggcacgugcuaccccggggacuucaucgacuacgaggagcuccgcgagcagcugagcuccgugagcuccuucgagcgguucgagaucuuccccaagaccagcuccuggcccaaccacgacagcaacaagggcgucaccgccgccugcccgaacgccggguccaagagcuucuacaagaaccugaucuggcucgugaagaagggcaacuccuaccccaagcugagcaagagcuacaucaacgacaaggggaaggaggugcugguccucuggggcauccaccaccccuccaccagcgcggaccagcagucccuguaccagaacgccgacgccuacguguucgugggcacgagccgcuacuccaagaaguucaagcccgagaucgccauccggccgaagguccgcgggcaggagggccggauggacuacuacuggacccugguggagcccggggacaagaucaccuucgaggccaccggcaaccucguggucccccgcuacgcguucgccauggagcggaacacgggcagcgggaucaucaucuccgacacccccgugcacgacugcaacaccaucugccagaccccgaagggcgccaucaacacgagccugcccuuccagaacauccaccccaucaccaucgggaagugccccaaguacgugaaguccaccaagcugcgccucgccaccggccugcggaacgucccgagcauccagucccgcgggcuguucggcgccaucgcgggcuucaucgagggcggguggacggggaugguggacggcugguacggguaccaccaccagaacgagcagggcagcggcuacgccgccgaccucaaguccacccagaacgccaucgacgagaucaccaacaaggugaacagcgucaucgagaagaugaacacccaguucacggccguggggaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggagccagcugaagaacaacgccaaggagaucgggaagggcugcuucgaguucuaccacaagugcgacaccaugugcauggaguccgugaagaacgggacguacgacuaccccaaguacagcgaggaggccaagcugaaccgcgaggagaucgacggcgugaagcucgaguccacccggaucuaccagauccuggccaucuacagcaccgucgccagcucccuggugcucguggucagccugggcgcgaucuccuucuggaugugcagcaacgggucccugcagugccgcaucugcaucuga

SEQ ID NO: 73779 - RNA, 1701 nt, Artificial Sequence
  derived and/or modified sequence opt1 from hemagglutinin__InfluenzaA__AIR94000
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccuccuuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaccaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 73780 - RNA, 1683 nt, Artificial Sequence
  derived and/or modified sequence opt1 from hemagglutinin__InfluenzaA__AIR94116
auggagaccgccagccugaucaccauccuccugguggucacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccacccgcugauccuggacacgugcaccaucgaggggcucaucuacggcaaccccuccugcgaccugcugcucgggggccgcgaguggagcuacaucguggagcggcccuccgccgucaacggccugugcuaccccgggaacguggagaaccuggaggagcuccgcagccuguucuccagcgcccgguccuaccagcgcauccagaucuucccggacaccaucuggaacgugagcuacuccggcaccagcaaggccugcuccgacagcuucuaccgguccaugcgcuggcugacccagaaggacaacgcguaccccauccaggacgcccaguacaccaacaaccaggggaagaacauccucuucauguggggcaucaaccacccgcccaccgacacggcccagaccaaccuguacacccggaccgacacgaccaccagcgucgccaccgaggagaucaaccgcacguucaagccccugaucgggccccggccccucgugaacggccugaugggccgcaucaacuacuacugguccgugcugaagcccgggcagacccuccggaucaagagcaacggcaaccugaucgcgccgugguacgggcacauccugagcggcgagucccacggccgcauccucaagaccgaccugaagcgggggagcugcaccguccagugccagacggagaagggcgggcugaacaccacccuccccuuccagaacguguccaaguacgccuucggcaacugcagcaaguacaucgggaucaagucccugaagcuggccgugggccuccgcaacguccccagccgguccagccgcggccuguucggggccaucgccggcuucaucgagggcgggugguccgggcugguggcgggcugguacggcuuccagcacagcaacgaccagggggugggcauggccgccgaccgggacuccacccagaaggccaucgacaagaucacgagcaaggucaacaacaucguggacaagaugaacaagcaguacgagaucaucgaccacgaguucaacgagguggagacccgccucaacaugaucaacaacaagaucgacgaccagauccaggacaucugggccuacaacgcggagcugcugguccuccuggagaaccagaagacccuggacgagcacgacgccaacgugaacaaccucuacaacaaggugaagcgggcccugggguccaacgccgucgaggacggcaaggggugcuucgagcuguaccacaagugcgacgaccagugcauggagaccauccgcaacggcacguacaaccggcgcaaguaccaggaggagagcaagcucgagcgccagaagaucgagggcgugaagcuggaguccgaggggaccuacaagauccugaccaucuacagcaccgucgccuccagccucgugaucgcgaugggcuucgccgccuuccuguucugggccauguccaacgggagcugccggugcaacaucugcaucuga

SEQ ID NO: 73781 - RNA, 1701 nt, Artificial Sequence
  derived and/or modified sequence opt1 from hemagglutinin__InfluenzaA__AIT38333
augaagaccaucaucacccugagcuacauccucugccacguguucgcccagaagauccacggcuccgacagcuccacggccacccugugccuggggcaccacgcgguccccaacggcacccucgugaagaccaucacgaacgaccagaucgaggugaccaacgccaccgagcugguccagagcuccagcaccgggcgcaucugcgacaacccgcaccggauccuggacggcaagaacugcacgcucaucgacgcccugcugggggacccccacugcgacgaguuccagaacaaggagugggaccucuucguggagcgcuccaacgccuacagcgacugcuaccccuacuacgugcccgacuacgccucccugcggagccuggucgcguccagcggcacccucgaguucaacaacgaguccuucaacuggaccggcaucagccaggacgggaccuccagcuccugccgccggggcagcgugaaguccuucuucagccgccugaacuggcugcacgggcucgaguacaaguacccggcccagaacgugacgaugcugaacaacgacgaguucgacaagcuguacaucuggggcguccaccaccccagcaccgacuccgaccagaccagccucuacgugcagaccuccgggcgggugacggucagcaccaagcgcucccagcagaccgugauccccaacaucggcagccggcccugggugcgcggcaucuccagccggaucuccauccacuggaccaucgucaagccgggggacauccugcugaucaacagcacgggcaaccucaucgcgccccgcggguacuucaagauccggggcggcaaguccagcaucaugcgcuccgacgcccccaucgacaacugcgacagcgagugcgugacccccaacgggaacaucccgaacgacaagcccuuccagaacgugaaccggaucaccuacggccccugcccccgcuacaucaagcagaacacccugaagcuggccacggggaugcggaacgucccggagaagcagacccgcggcgugcucggggccaucgccggcuucaucgagaacggcugggaggggaugguggacggcugguacggguuccggcaccagaacuccgagggcaccgggcaggccgccgaccucaagagcacccaggcggccaucgaccagaucaacggcaagcugaaccgccugaucggcaagacgaacgagaaguuccaccagaucgagaaggaguucuccgagaucgaggggcggguccaggaccuggagaaguacguggaggacaccaagaucgaccuguggagcuacaacgccgagcuccuggugguccuggagaaccagcacaccaucgaccucaccgacuccgagaugaacaagcuguucgagcgcacgcgccggcagcugcgcgagaacgccgaggacaugggcaacgggugcuucaagaucuaccacaagugcgacaacgccugcaucggcagcauccggaacgggaccuacgugcacgacgucuaccgcgacgaggcgcucaacaaccgguuccagaucaagggcguggagcucaagagcggcuacaaggacuggauccuguggaucuccuucgccaucagcugcuuccugcugugcgccgugcugcucggguucaucaccugggccugccagaagggcaacauccgcugcaacaucugcaucuga

SEQ ID NO: 73782 - RNA, 1698 nt, Artificial Sequence
  derived and/or modified sequence opt1 from hemagglutinin__InfluenzaA__AIT38344
augaagaucaagcugcucauccugcugugcaccuucaccgccacguacgccgacaccaucugcaucggcuaccacgcgaacaacagcaccgacaccguggacacgguccucgagaagaacgugaccgugacccacuccgucaaccugcuggaggacagccacaacgggaagcucugccugcugcgcggcaucgcgccccuccagcuggggaacugcuccguggccggcuggauccuggggaacccggagugcgagagccucaucuccaaggagagcugguccuacaucguggagaagcccaaccccgagaacgggaccugcuaccccggcuacuucgccgacuacgaggagcugcgggagcagcugagcuccgucagcuccuucgagcgcuucgagaucuucccgaaggagagcuccuggcccaaccacacggugaccggggugagcgccuccugcagcuacaacggcaaggggaacuucuacaagaaccuccuguggcugacccggaagaacggccucuaccccaaccuguccaagagcuacaccaacaacaaggagaaggagguccugauccucuggggcgugcaccaccccuccaacaucaaggaccagcgcacgcuguaccacaccgagaacgccuacgugagcgucgugagcucccacuacagccggcgcuucaccccggagaucaccaagcggcccaaggugcgcgaccaggagggccggaucaacuacuacuggacgcugcucgagcccggcgacaccaucaucuucgaggccaacgggaaccugaucgcccccugguacgccuucgcgcugucccgcggcuucgggagcggcaucaucaccuccaacgccccgauggacgagugcgaggccaagugccagacgccccggggcgccaucaacagcucccuccccuuccagaacguccaccccgugaccaucggggagugcccgaaguacgugcgcagcgccaagcugcggauggucaccggccugcgcaacauccccuccauccagagccggggccucuucggggcgaucgccggguucaucgagggcggcuggaccgggaugaucgacggcugguacggguaccaccaccagaacgagcagggcuccggguacgccgccgacaaggagagcacccagaacgccaucaacggcaucacgaacaaggugaacuccgugaucgagaagaugaacacccaguucaccaccgucggcaaggaguucaacaagcuggagcgccggauggagaaccugaacaagaagguggacgacggguuccucgacaucuggacguacaacgcggagcugcuggugcuccuggagaacgagcgcacccuggacuuccacgacagcaacgucaagauccucuacgagaaggugaagucccagcugaagaacaacgccaaggagaucggcaacgggugcuucgaguucuaccacaagugcaacaacgagugcauggagagcgucaagaacggcaccuacgacuaccccaaguacuccgaggagagcaagcugaaccgggagaagaucgacggggugaagcucgaguccaugggcguguaccagauccuggccaucuacagcaccgucgccagcucccuggugcuccuggugagccugggcgccaucuccuucuggaugugcagcaacgggucccuccagugccgcaucugcaucuga

SEQ ID NO: 73783 - RNA, 1698 nt, Artificial Sequence
  derived and/or modified sequence opt1 from hemagglutinin__InfluenzaA__AIT38360
augaagaucaagcugcucauccugcugugcaccuucaccgccacguacgccgacaccaucugcaucggcuaccacgcgaacaacagcaccgacaccguggacacgguccucgagaagaacgugaccgugacccacuccgucaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucguggagaagcccaaccccgagaacgggaccugcuaccccggcuacuucgccgacuacgaggagcugcgcgagcagcugagcuccgucagcuccuucgagcgguucgagaucuucccgaaggagagcuccuggcccaaccacacggugaccggggugagcgccuccugcagcuacaacggcaaggggaacuucuacaagaaccuccuguggcugacccgcaagaacggccucuaccccaaccuguccaagagcuacaccaacaacaaggagaaggagguccugauccucuggggcgugcaccaccccuccaacaucgaggaccagcggacgcuguaccacaccgagaacgccuacgugagcgucgugagcucccacuacagccgccgguucaccccggagaucaccaagcgccccaaggugcggggccaggagggccgcaucaacuacuacuggacgcugcucgagcccggggacaccaucaucuucgaggccaacggcaaccugaucgcccccugguacgccuucgcgcugucccgggggcucggcagcggcaucaucaccuccaacgccccgauggacgagugcgaggccaagugccagacgccccgcggggccaucaacagcucccugcccuuccagaacguccaccccgugaccaucggcgagugcccgaaguacgugcggagcgccaagcugcgcauggucaccgggcuccggaacauccccuccauccagagccgcggccuguucggggcgaucgccggcuucaucgagggcggguggaccggcaugaucgacgggugguacggcuaccaccaccagaacgagcagggguccggcuacgccgccgacaaggagagcacccagaacgccaucaacggcaucacgaacaaggugaacuccgugaucgagaagaugaacacccaguucaccaccgucgggaaggaguucaacaagcuggagcggcgcauggagaaccucaacaagaagguggacgacggcuuccuggacaucuggacguacaacgcggagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacaacgagugcauggagagcgucaagaacgggaccuacgacuaccccaaguacuccgaggagagcaagcucaaccgcgagaagaucgacggcgugaagcuggaguccaugggcguguaccagauccuggccaucuacagcaccgucgccagcucccucgugcugcuggugagccucggggccaucuccuucuggaugugcagcaacggcucccugcagugccggaucugcaucuga

SEQ ID NO: 73784 - RNA, 1701 nt, Artificial Sequence; identical to SEQ ID NO: 71048
  derived and/or modified sequence opt1 from hemagglutinin__InfluenzaA__AIT93147

SEQ ID NO: 73785 - RNA, 1701 nt, Artificial Sequence; identical to SEQ ID NO: 63677
  derived and/or modified sequence opt1 from hemagglutinin__InfluenzaA__AIU39700

SEQ ID NO: 73786 - RNA, 1701 nt, Artificial Sequence
  derived and/or modified sequence opt1 from hemagglutinin__InfluenzaA__AIU39702
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccuccuuccccuuccagaacauccaccccaucaccaucgggaagugccccaaguacgucaagagcaccaagcugcggcuggcgaccggccuccgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagagcacccgcaucuaccagauccucgcgaucuacuccaccguggccagcagccugguccugguggugucccucggggccaucagcuucuggaugugcuccaacggcagccugcagugccggaucugcaucuga

SEQ ID NO: 73787 - RNA, 1701 nt, Artificial Sequence; identical to SEQ ID NO: 67917
  derived and/or modified sequence opt1 from hemagglutinin__InfluenzaA__AIU39704

SEQ ID NO: 73788 - RNA, 1704 nt, Artificial Sequence
  derived and/or modified sequence opt1 from hemagglutinin__InfluenzaA__AIU46609
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggaaccugaacgacuacgaggagcucaagcaccuccugucccgcaucaaccacuucgagaagauccugaucauccccaagagcuccuggaccaaccacgagacgagccugggcgucuccgccgcgugcccguaccagggcacccccagcuucuuccggaacgugguguggcugaucaagaagaacgacgccuaccccaccaucaagaucuccuacaacaacaccaaccaggaggaccuccugauccugugggggauccaccacagcaacaacgccgccgagcagacgaaccucuacaagaacccgaccaccuacaucuccgucggcaccagcacgcugaaccagcgccuggugcccaagaucgcgacccggucccaggugaacgggcagcgcggccggauggacuucuucuggaccauccucaagcccaacgacgccauccacuucgagagcaacgggaacuucaucgcccccgaguacgccuacaagaucgucaagaagggcgacuccaccaucaugaaguccgagguggaguacggccacugcaacacgaagugccagaccccgaucggggccaucaacagcagcaugcccuuccacaacauccacccccugaccaucggcgagugccccaaguacgucaagagcaacaagcuggugcucgcgaccgggcugcgcaacuccccgcugcgggagaagcgccggaagcgcggccucuucggcgccaucgccggguucaucgagggcggguggcagggcaugguggacgggugguacggcuaccaccacagcaacgagcagggcuccggguacgccgccgacaaggagagcacgcagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacgcuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggugaagcuggagagcaucggcaccuaccagauccuguccaucuacagcaccgucgcguccagccucgcccuggccaucaucguggccgggcugucccucuggaugugcagcaacggcucccugcagugccgcaucugcaucuga

SEQ ID NO: 73789 - RNA, 1689 nt, Artificial Sequence
  derived and/or modified sequence opt1 from hemagglutinin__InfluenzaA__AIU46714
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaaccccaaguacucccucugcuacccgggcagcuucaacgacuacgaggagcugaagcaccuccuguccagcgugaagcacuucgagaaggugaagauccugcccaaggacggguggacgcagcacaagaccgacggcggguccaaggccugcgccgucagcggcaagcaguccuucuuccgcaacaugguguggcugaccaagaaggggcagaacuaccccguggcgaagcggagcuacaacaacaccuccggcgagcagaugcucaucaucuggggcguccaccaccccaacgacgaggaggagcagcgcgcccuguaccagaagguggggacguacgugagcgccuccaccagcacccugaacaagcgguccaccccggagaucgccgcgcgccccgaggucaacggccucgggagccggauggaguucuccuggacgcugcuggacgugugggacaccaucaacuucgagagcaccggcaaccucguggcccccgaguacggcuucaagaucuccaagcgcgggagcagcggcaucaucaagaccgaggggacgcugggcaacugcgagaccaagugccagacgccccugggggccaucaacaccacccucccguuccacaacguccacccccugaccaucggcgagugccccaaguacgugaaguccgagaagcuggugcucgccaccggccugcggaacgucccccagaucgagagccgcgggcuguucggcgccaucgcgggguucaucgagggcggguggcagggcaugguggacggcugguacggguaccaccacuccaacgaccagggcagcggguacgccgccgacaaggaguccacccagaaggccuucgaccggaucacgaacaaggugaacagcgucaucgagaagaugaacacccaguucgaggccgugggcaaggaguucuccaaccucgagcgccggcuggagaaccugaacaagaagauggaggacggguuccucgacguguggaccuacaacgcggagcugcugguccucauggagaacgagcgcacccuggacuuccacgacagcaacgugaagaaccuguacgacaagguccggaugcagcuccgcgacaacgugaaggagcugggcaacggcugcuucgaguucuaccacaagugcgacaacgagugcaugaacuccgugaagaacgggacguacgacuacccgaaguacgaggaggagagcaagcugaagcggaacgagaucaagggcgucaagcucuccagcauggggguguaccagauccuggccaucuacgccaccguggccggcucccugagccucgccaucaugaucgcgggcaucuccuucuggaugugcagcaacgggucccugcagugccgcaucugcaucuga

SEQ ID NO: 73790 - RNA, 1701 nt, Artificial Sequence
  derived and/or modified sequence opt1 from hemagglutinin__InfluenzaA__AIV09219
augaaggccauccuggugguccuccuguacaccuucgccaccacgaacgcggacauccugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccaccuccagcugguccuacaucguggagacgagcuccagcgacaacgggaccugcuaccccggcgacuucaucgacuacgaggagcugcgggagcagcuguccagcguguccagcuucgagcgcuucgagaucuuccccaagaccuccagcuggcccgaccacgacuccaacaagggcgucaccgccgccugcccgcacgccggcgccgggagcuucuacaagaaccucaucuggcuggugaagaagggcaacuccuaccccaagcugagcaaguccuacaucaacgacaaggggaaggaggugcucguccuguggggcauccaccacccgcccacgagcgccgaccagcagcggcuguaccagaacgcggacgccuacguguucgugggcaccagccgcuacuccaagaaguucaagcccgagaucgccauccggcccaagguccgcgaccaggaggggcggaugaacuacuacuggacccucguggagcccggcgacaagaucaccuucgaggccacggggaaccugguggucccccgcuacgccuucgcgauggagcggaacgccggcagcggcaucaucaccuccgacaccccggugcacgacugcaacaccacgugccagacccccaagggggccaucaacaccagccugcccuuccagaacauccaccccaucaccaucggcaagugcccgaaguacgugaaguccacgaagcuccgccuggccaccgggcugcggaacguccccagcauccagucccgcggccucuucggggccaucgcgggcuucaucgagggcggguggaccggcaugguggacgggugguacggcuaccaccaccagaacgagcaggggagcggcuacgccgccgaccugaaguccacccagaacgccaucgacgagaucacgaacaaggugaacagcgucaucgacaagaugaacacccaguucaccgccgugggcaaggaguucaaccaccuggagaagcggaucgagaaccucaacaagaaggucgacgacggguuccuggacaucuggaccuacaacgcggagcugcucgugcugcuggagaacgagcgcacgcucgacuaccacgacuccaacgugaagaaccuguacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcucaaccgcgaggagaucgacggggugaagcuggaguccacccggaucuaccagauccuggccaucuacagcaccgucgccuccagccucgugcugguggucucccugggcgcgaucagcuucuggaugugcagcaacggcucccuccagugccgcaucugcaucuga

SEQ ID NO: 73791 - RNA, 1701 nt, Artificial Sequence
  derived and/or modified sequence opt1 from hemagglutinin__InfluenzaA__AIW60689
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccgacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagcaucuacgugcaggccuccgggcgcgucaccgugagcacgaagcggagccagcagaccgugaucccgaacaucggcucccgccccuggguccgggggaucagcucccgcaucagcaucuacuggaccaucgugaagcccggcgacauccugcucaucaacuccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggcuucaucgagaacgggugggagggcaugguggacgggugguacggcuuccgccaccagaacuacgaggggaccggccaggccgccgaccucaagagcacccaggcggccaucaaccagaucaacggcaagcugaaccggcugaucgagaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggacccgcaagcagcugcgcgagaacgccgaggacaugggcaacgggugcuucaagaucuaccacaagugcgacaacgcgugcaucggcagcauccggaacgggacguacgaccacgacgccuaccgcgacgaggcccucaacaaccgguuccagaucaagggcgucgagcugaaguccggcuacaaggacuggauccuguggaucagcuucgccaucuccugcuuccuccugugcgugguccugcucggguucaucaugugggccugccagaagggcaacauccgcugcaacaucugcaucuga

SEQ ID NO: 73792 - RNA, 1701 nt, Artificial Sequence
  derived and/or modified sequence opt1 from hemagglutinin__InfluenzaA__AIW60690
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccgacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgcgucaccgugagcacgaagcggagccagcagaccgugaucccgaacaucggcucccgccccuggguccgcggggugagcucccggaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacuacgaggggaccggccaggccgccgaccucaagagcacccaggcggccaucaaccagaucaacggcaagcugaaccggcugaucgagaagaccaacgagaaguuccaccagaucgagaaggaguucuccgagguggaggggcgcauccaggaccuggagaaguacguggaggacacgaagaucgaccucuggagcuacaacgccgagcugcuggucgcccucgagaaccagcacaccaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggacguacgaccacgacgccuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 73793 - RNA, 1701 nt, Artificial Sequence
  derived and/or modified sequence opt1 from hemagglutinin__InfluenzaA__AIW60691
augaagaccaucaucgcccugagcuacauccucugccugguguucgcccagaagcugcccggcaacgacaacuccaccgcgacgcucugccuggggcaccacgccgucccgaacggcacccuggugaaggccaucaccaacgaccagaucgaggugaccaacgccacggagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggcguacuccgacugcuaccccuacgacgugccggacuacgccagccuccggucccuggucgccagcuccggcacccuggaguucacgaacgagggguucaacuggaccggcguggcccaggacgggaccagcuacgcgugcaagcgcggcuccgugaaguccuucuucucccggcucaacuggcugcacaagcuggaguacaaguaccccgcccucaacgucaccaugcccaacaacgacaaguucgacaagcuguacaucuggggcgugcaccaccccagcacggacuccgaccagacccgccuguacgugcaggccagcgggcgggucaccguguccaccaagcgcagccagcagacggugaucccgaacaucggcagccggcccuggguccgcgggaucuccagccggaucuccaucuacuggaccaucgugaagcccggcgacauccuccugaucaacagcaccgggaaccugaucgcgccccgcggcuacuucaagauccgguccggcaagagcuccaucaugcgcagcgacgccccgaucgggaacugcaacuccgagugcaucacccccaacggcagcauccccaacgacaagcccuuccagaacgugaaccggaucacguacggggccugcccgcgcuacgucaagcagaacacccucaagcuggccaccggcaugcggaacgugcccgagaagcagacccgcgggaucuucggcgccaucgccggcuucaucgagaacgggugggagggcaugguggacgggugguacggcuuccggcaccagaacuccgaggggacgggccaggccgcggaccucaagagcacccaggccgccaucaaccagaucaacggcaagcugaaccgccugaucgagaagaccaacgagaaguuccaccagaucgagaaggaguucuccgaggucgaggggcggauccaggaccuggagaaguacguggaggacaccaagaucgaccucuggagcuacaacgccgagcugcugguggcccucgagaaccagcacacgaucgaccugaccgacuccgagaugaacaagcuguucgagcgcacccgcaagcagcuccgggagaacgcggaggacaugggcaacgggugcuucaagaucuaccacaagugcgacaacgccugcaucggcagcauccgcaacgggaccuacgaccacgacgucuaccgggacgaggcccugaacaaccgcuuccagaucaagggcguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 73794 - RNA, 1701 nt, Artificial Sequence
  derived and/or modified sequence opt1 from hemagglutinin__InfluenzaA__AIW60692
augaagaccaucaucgcccugagcuacauccucugccugguguucgcccagaagcugcccggcaacgacaacuccaccgcgacgcucugccuggggcaccacgccgucccgaacggcacccuggugaaggccaucaccaacgaccagaucgaggugaccaacgccacggagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggcguacuccgacugcuaccccuacgacgugccggacuacgccagccuccggucccuggucgccagcuccggcacccuggaguucacgaacgagggguucaacuggaccggcguggcccaggacgggaccagcuacgcgugcaagcgcggcuccgugaaguccuucuucucccggcucaacuggcugcacaagcuggaguacaaguaccccgcccucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgggaacugcaacagcgagugcaucacccccaacggcuccauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacagcgaggggacgggccaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacgucuaccgcgacgaggcccugaacaaccgguuccagaucaagggcguggagcucaagagcggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 73795 - RNA, 1701 nt, Artificial Sequence
  derived and/or modified sequence opt1 from hemagglutinin__InfluenzaA__AIW60693
augaagaccaucaucgcccugagcuacauccucugccugguguucgcccagaagcugcccggcaacgacaacuccaccgcgacgcucugccuggggcaccacgccguccugaacggcacccucgugaagaccaucaccaacgaccagaucgaggugacgaacgccaccgagcugguccagaacagcuccaccgggcgcaucugcgacagcccgcaccagauccuggacggcgagaacugcacccucaucgacgcccugcugggggacccccacugcgacggcuuccagaacaaggagugggaccucuucguggagcgguccaaggccuacagcaacugcuaccccuacgacgugcccgacuacgcgucccugcgcagccuggucgccuccagcggcacgcucgaguucaacaacgaguccuucaacuggaccgggguggcccagaacggcaccagcuccgccugcaagcggcgcagcaucaaguccuucuucagccggcugaacuggcugcaccagcucaaguacaaguacccggcgcugaacgugaccaugcccaacaacgagaaguucgacaagcuguacaucuggggcguccaccaccccuccacggacagcgaccagaccuccaucuacgcccaggccagcgggcgcgugaccgugagcaccaagcggucccagcagacggucauccccaacaucgggagccgcccgugggugcggggcguguccagcaucaucuccaucuacuggaccaucgucaagcccggcgacauccuccugaucaacagcaccgggaaccugaucgcgccccgcggcuacuucaagauccgguccggcaagagcuccaucaugcgcagcgacgcccccaucgggaagugcaacuccgagugcaucaccccgaacggcagcauccccaacgacaagcccuuccagaacgugaaccggaucacguacggggccugcccccgcuacgugaagcagaacacccucaagcuggccaccggcaugcggaacgucccggagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacacgaucgaccugaccgacuccgagaugaacaagcuguucgagcgcacccggaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 73796 - RNA, 1701 nt, Artificial Sequence
  derived and/or modified sequence opt1 from hemagglutinin__InfluenzaA__AIW60694
augaagaccaucaucgcccugagcuacauccucugccugguguucgcccagaagcugcccggcaacgacaacuccaccgcgacgcucugccuggggcaccacgccguccugaacggcacccucgugaagaccaucaccaacgaccagaucgaggugacgaacgccaccgagcugguccagaacagcuccaccgggcgcaucugcgacagcccgcaccagauccuggacggcgagaacugcacccucaucgacgcccugcugggggacccccacugcgacggcuuccagaacaaggagugggaccucuucguggagcgguccaaggccuacagcaacugcuaccccuacgacgugcccgacuacgcgucccugcgcagccuggucgccuccagcggcacgcucgaguucaacaacgaguccuucaacuggaccgggguggcccagaacggcaccagcuccgccugcaagcggcgcagcaucaaguccuucuucagccggcugaacuggcugcaccagcucaaguacaaguacccggcgcugaacgugaccaugcccaacaacgagaaguucgacaagcuguacaucuggggcguccaccaccccuccacggacagcgaccagaccucccucuacgcccaggccagcgggcgcgugaccgugagcaccaagcggucccagcagacggucauccccaacaucgggagccgcccgugggugcggggcguguccagccgcaucuccaucuacuggaccaucgucaagcccggcgacauccugcugaucaacagcaccgggaaccucaucgcgccccggggcuacuucaagauccgcuccggcaagagcuccaucaugcggagcgacgcccccaucgggaagugcaacuccgagugcaucaccccgaacggcagcauccccaacgacaagcccuuccagaacgugaaccgcaucacguacggggccugcccccgguacgugaagcagaacacccugaagcuggccaccggcaugcgcaacgucccggagaagcagacccgggggaucuucggcgccaucgccggguucaucgagaacggcugggagggcaugguggacgggugguacggcuuccgccaccagaacuccgaggggacgggccaggccgcggaccucaagagcacccaggccgccaucaaccagaucaacgggaagcugaaccggcugaucgagaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagcggacccgcaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcgucgagcucaaguccggguacaaggacuggauccuguggaucagcuucgccaucagcugcuuccugcucugcgugguccugcugggcuucaucaugugggccugccagaagggcaacauccgcugcaacaucugcaucuga

SEQ ID NO: 73797 - RNA, 1701 nt, Artificial Sequence
  derived and/or modified sequence opt1 from hemagglutinin__InfluenzaA__AIW60695
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaacuacaaguaccccgcgcucaacgugaccaugcccaacaacgagaaguucgacaagcuguacaucuggggcguccaccaccccagcacggacuccgaccagaucagcaucuacgcccaggccccggggcgggugaccgugagcaccaagcgcucccagcagaccgucauccccaacaucggcagccggcccugggugcgcggcguguccagcaucaucuccaucuacuggacgaucgucaagcccggggacauccugcucaucaacugcaccggcaaccugaucgccccgcggggguacuucaagauccgcagcggcaaguccagcaucaugcgguccgacgccagcaucggcaagugcaacuccgagugcaucacccccaacgggagcauccccaacgacaagcccuuccagaacgugaaccgcaucaccuacggcgcgugcccgcgguacgugaagcagaacacgcugaagcucgccaccgggaugcgcaacguccccgagaagcagacccggggcaucuucggggccaucgccggcuucaucgagaacggcugggaggggaugguggacggcugguacggguuccgccaccagaacuccgagggcaccgggcaggccgcggaccugaaguccacgcaggccgccaucaaccagaucaacggcaagcugaaccggcucaucgagaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagcggaccaagaagcagcugcgcgagaacgcggaggacauggggaacggcugcuucaagaucuaccacaagugcgacaacgccugcaucgggagcauccggaacggcaccuacgaccacgacguguaccgcgacgaggcccucaacaaccgcuuccagaucaagggggucgagcugaaguccggcuacaaggacuggauccuguggaucagcuucgccaucagcugcuuccuccugugcgugguccugcucggcuucaucaugugggccugccagaaggggaacauccggugcaacaucugcaucuga

SEQ ID NO: 73798 - RNA, 1701 nt, Artificial Sequence
  derived and/or modified sequence opt1 from hemagglutinin__InfluenzaA__AIW60696
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggaccagaacgggaccuccagcgccugcaagcgccgguccaacaagagcuucuucucccgccucaacuggcugcaccagcugaaguacaaguaccccgcccucaacguggcgaugcccaacaacgagaaguucgacaagcuguacaucuggggcguccaccaccccagcaccgacuccgaccagaucagccuguacgcccaggccccggggcgggugacggugagcaccaagcgcucccagcagaccgucauccccaacaucggcagccggcccugggugcgcggcguguccagccggaucuccaucuacuggaccaucgucaagcccggggacauccuccugaucaacugcacgggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacccucaagcuggccacggggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacccaggccgccaucaaccagaucaacggcaagcucaaccgccugaucgagaagacgaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugaccgacuccgagaugaacaagcuguucgagcgcacgaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 73799 - RNA, 1701 nt, Artificial Sequence
  derived and/or modified sequence opt1 from hemagglutinin__InfluenzaA__AIW60697
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcuccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgacaccgacuccgugcagaucagccuguacgcccaggcgagcgggcggaucaccguguccacgaagcgcagccagcagaccgucaucccgaacaucggcucccggccccgcgugcgggacaucagcucccgcaucagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggaccggccaggccgccgaccugaaguccacccaggccgcgaucaaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgccugcaucggguccauccgcaacggcacguacgaccacgacguguaccgggacgaggcgcucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 73800 - RNA, 1701 nt, Artificial Sequence
  derived and/or modified sequence opt1 from hemagglutinin__InfluenzaA__AIW60698
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacaucuccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 73801 - RNA, 1701 nt, Artificial Sequence
  derived and/or modified sequence opt1 from hemagglutinin__InfluenzaA__AIW60699
augaagaccaucaucgcccugagcuacauccucugccugguguucgcccagaagcugcccggcaacgacaacuccaccgcgacgcucugcaucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcagcaaggccuacuccaacugcuaccccuacgacgugccggacuacgcgagccugcggucccugaucgccagcuccgggacgcucgaguucaacaacgagagcuucaacuggaccggcgucacccagaacgggaccuccagcgccugcaagcgccgguccaacaacagcuucuucucccgccugaacuggcugacgcaccucaaguucaaguaccccgcccugaacgugaccaugcccaacaacgaggaguucgacaagcuguacaucuggggcgugcaccaccccgucaccgacaacgaccagaucagccucuacgcgcaggccuccgggaagaucaccgugagcacgaagcggagccagcagaccgugaucccgaacaucggcucccgcccccggguccgcgacauccccagccggaucuccaucuacuggaccaucgugaagcccggcgacauccugcugaucaagagcaccgggaaccucaucgccccgcgcggcuacuucaagauccgguccgggaaguccuccaucaugcgcagcgacgcccccaucggcaagugcaacuccgagugcaucacgcccaacggcagcauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgaggagaccaagaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgcuuccagaucaaggggguggagcucaaguccggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 73802 - RNA, 1701 nt, Artificial Sequence
  derived and/or modified sequence opt1 from hemagglutinin__InfluenzaA__AIW60700
augaagaccaucaucgcccugagcuacauccucugccugguguucgcccagaagcugcccggcaacgacaacuccaccgcgacgcucugcaucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccugaucgccagcuccgggacgcucgaguucaacaacgagagcuucaacuggaccggcgucacccagaacgggaccuccagcgccugcaagcgccgguccaacaacagcuucuucucccgccugaacuggcugacgcaccucaaguucaaguaccccgcccugaacgugaccaugcccaacaacgaggaguucgacaagcuguacaucuggggcgugcaccaccccgggaccgacaacgaccagaucagccucuacgcgcaggccuccggcaagaucaccgucagcacgaagcggagccagcagaccgugaucccgaacaucggcucccgcccccgggugcgcgacauccccagccggaucuccaucuacuggaccaucgucaagcccggggacauccugcugaucaacagcaccggcaaccucaucgccccgcgcggguacuucaagauccgguccggcaagagcuccaucaugcgcagcgacgcccccaucggcaagugcaacuccgagugcaucacgcccaacgggagcauccccaacgacaagccguuccagaacgugaaccggaucaccuacggcgccugcccccgcuacgugaagcagaacacccugaagcuggcgaccgggaugcggaacguccccgagaagcagacgcgcggcaucuucggggccaucgccggcuucaucgagaacggcugggaggggaugguggacggcugguacggguuccggcaccagaacuccgagggcaucgggcaggccgccgaccucaagagcacccaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacacgaucgaccugaccgacuccgagaugaacaagcuguucgaggagaccaagaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgcuuccagaucaagggcgucgagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 73803 - RNA, 1701 nt, Artificial Sequence
  derived and/or modified sequence opt1 from hemagglutinin__InfluenzaA__AIW60701
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcuccaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucuucccguacgcccaggcgagcgggcggaucacgguguccaccaagcgcagccagcagaccgugauccccaacaucggcagccggccccgcguccggaacauccccucccgcaucagcaucuacuggaccaucgugaagccgggcgacauccugcugaucaacuccacggggaaccucaucgcgccccggggcuacuucaagauccgcagcgggaaguccagcaucaugcgguccgacgcccccaucggcaagugcaacagcgagugcaucacccccaacggcuccaucccgaacgacaagcccuuccagaacgugaaccgcaucaccuacggggccugcccccgguacgucaagcagaacacccugaagcuggccacgggcaugcgcaacgugcccgagaagcagacccgggggaucuucggcgccaucgccggguucaucgagaacggcugggagggcaugguggacgggugguacggcuuccgccaccagaacagcgaggggaucggccaggccgccgaccucaaguccacccaggccgcgaucgaccagaucaacgggaagcugaaccggcugaucggcaagaccaacgagaaguuccaccagaucgagaaggaguucagcgaggucgagggccgcauccaggaccucgagaaguacguggaggacacgaagaucgaccugugguccuacaacgccgagcugcucguggcccuggagaaccagcacaccaucgaccugaccgacagcgagaugaacaagcuguucgagaagaccaagaagcagcuccgggagaacgccgaggacauggggaacggcugcuucaagaucuaccacaagugcgacaacgccugcaucggguccauccgcaacggcacguacgaccacgacgucuaccgcgacgaggcgcugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 73804 - RNA, 1701 nt, Artificial Sequence
  derived and/or modified sequence opt1 from hemagglutinin__InfluenzaA__AIW60702
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcccaggcgagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacagcgaggggaucggccaggccgccgaccugaaguccacccaggccgcgaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgccugcaucggguccauccgcaacggcacguacgaccacgacgucuaccgcgacgaggcgcucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 73805 - RNA, 1701 nt, Artificial Sequence; identical to SEQ ID NO: 73549
  derived and/or modified sequence opt1 from hemagglutinin__InfluenzaA__AIZ07211

SEQ ID NO: 73806 - RNA, 1701 nt, Artificial Sequence
  derived and/or modified sequence opt1 from hemagglutinin__InfluenzaA__AIZ07212
augaagaccaucauggcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccagcggccggaucaccgugagcaccaagcgcucccagcaggccgugaucccgaacaucggcagccggccccgcauccggaacauccccucccgcaucagcaucuacuggaccaucgucaagcccggggacauccugcugaucaacuccacgggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacggcugggaggggaugauggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcguggagcucaaguccggcuacaaggacuggauccuguggaucagcuucgccaucagcugcuuccugcucugcgucgcccugcugggguucaucaugugggcgugccagaagggcaacauccggugcaacaucugcaucuga

SEQ ID NO: 73807 - RNA, 1683 nt, Artificial Sequence
  derived and/or modified sequence opt1 from hemagglutinin__InfluenzaA__AJD78175
auggagaccgccagccugaucaccauccuccugguggucacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugcugcucgggggccgcgaguggagcuacaucguggagcggcccuccgccgccaacggccugugcuaccccgggaacgucgagaaccuggaggagcuccgcagccuguucuccagcgcccgguccuaccagcgcauccagaucuucccggacaccaucuggaacgugagcuacuccggcaccagcaaggcgugcuccgacagcuucuaccgguccaugcgcuggcugacccagaaggacaacaccuaccccauccaggacgcccaguacaccaacaaccaggggaagaacauccucuucauguggggcaucaaccacccgcccacggacaccgcccagaccaaccuguacacccggacggacaccaccaccagcguggccacggaggagaucaaccgcaccuucaagccccugaucgggccccggccccucgucaacggccugaugggccgcaucaacuacuacugguccgugcugaagcccgggcagacccuccggaucaagagcaacggcaaccugaucgcgccgugguacgggcacauccugagcggcgagucccacggccgcauccucaagaccgaccugaagcgggggagcugcacggugcagugccagaccgagaagggcgggcugaacaccacccuccccuuccagaacgucuccaaguacgccuucggcaacugcagcaaguacaucgggaucaagucccugaagcuggccgugggccuccgcaacgugcccagccgguccagccgcggccuguucggggccaucgccggcuucaucgagggcgggugguccgggcuggucgcgggcugguacggcuuccagcacagcaacgaccagggggugggcauggccgccgaccgggacuccacgcagaaggccaucgacaagaucaccagcaaggugaacaacaucgucgacaagaugaacaagcaguacgagaucaucgaccacgaguucaacgagguggagacccgccucaacaugaucaacaacaagaucgacgaccagauccaggacaucugggccuacaacgcggagcugcuggugcuccuggagaaccagaagacccuggacgagcacgacgccaacgucaacaaccucuacaacaaggugaagcgggcccugggguccaacgccguggaggacggcaaggggugcuucgagcuguaccacaagugcgacgaccagugcauggagacgauccgcaacggcaccuacaaccggcgcaaguaccaggaggagagcaagcucgagcgccagaagaucgagggcgucaagcuggaguccgaggggaccuacaagauccugaccaucuacagcaccguggccuccagccucgucaucgcgaugggcuucgccgccuuccuguucugggccauguccaacgggagcugccggugcaacaucugcaucuga

SEQ ID NO: 73808 - RNA, 1683 nt, Artificial Sequence
  derived and/or modified sequence opt1 from hemagglutinin__InfluenzaA__AJD78187
auggagaccgccagccugaucaccauccuccugguggucacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccacccgcugauccuggacacgugcaccaucgaggggcucaucuacggcaaccccuccugcgaccugcugcucgggggccgcgaguggagcuacaucguggagcggcccuccgccgucaacggccugugcuaccccgggaacguggagaaccuggaggagcuccgcagccuguucuccagcgcccgguccuaccagcgcauccagaucuucccggacaccaucuggaacgugagcuacuccggcaccagcaagaccugcuccgacagcuucuaccgguccaugcgcuggcugacccagaaggacaacgccuaccccauccaggacgcgcaguacaccaacaaccaggggaagaacauccucuucauguggggcaucaaccacccgcccacggacaccacccagaccaaccuguacacgcggaccgacaccaccacgagcgucgccaccgaggagaucaaccgcaccuucaagccccugaucgggccccggccccucgugaacggccugaugggccgcaucaacuacuacugguccgugcugaagcccgggcagacccuccggaucaagagcaacggcaaccugaucgccccgugguacgggcacauccugagcggcgagucccacggccgcauccucaagacggaccugaagcgggggagcugcaccguccagugccagaccgagaagggcgggcugaacaccacgcuccccuuccagaacguguccaaguacgccuucggcaacugcagcaaguacaucgggaucaagucccugaagcuggcggugggccuccgcaacguccccagccgguccagccgcggccuguucggggccaucgccggcuucaucgagggcgggugguccgggcugguggccggcugguacggcuuccagcacagcaacgaccagggggugggcauggccgcggaccgggacuccacccagaaggccaucgacaagaucaccagcaaggucaacaacaucguggacaagaugaacaagcaguacgagaucaucgaccacgaguucuccgagguggagacccgccucaacaugaucaacaacaagaucgacgaccagauccaggacaucugggccuacaacgccgagcugcugguccuccuggagaaccagaagacgcuggacgagcacgacgccaacgugaacaaccucuacaacaaggugaagcgggcgcuggggagcaacgccgucgaggacggcaaggggugcuucgagcuguaccacaagugcgacgaccagugcauggagaccauccgcaacggcaccuacaaccggcgcaaguaccaggaggaguccaagcucgagcgccagaagaucgagggcgugaagcuggagagcgaggggaccuacaagauccugaccaucuacuccacggucgccagcucccucgugaucgccaugggcuucgccgcguuccuguucugggccaugagcaacgggagcugccggugcaacaucugcaucuga

SEQ ID NO: 73809 - RNA, 1683 nt, Artificial Sequence
  derived and/or modified sequence opt1 from hemagglutinin__InfluenzaA__AJD78199
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugagccuggaggggcgcgagugguccuacaucguggagcggcccagcgccgucaacggccucugcuaccccggcaacguggagaaccuggaggagcugcgcucccucuucagcuccgcccggagcuaccagcgcauccagaucuucccggacaccaucuggaacguguccuacgacgggaccagcaccgccugcuccggcagcuucuaccgguccaugcgcuggcugacccggaagaacggggacuaccccauccaggacgcgcaguacaccaacaaccagggcaagaacauccuguucaugugggggaucaaccacccgcccacggacaccacccagcgcgaccucuacacccggacggacaccaccaccagcgucgccacggaggagaucaaccgcaucuucaagccccugaucggcccccggccccuggugaacggccucauggggcgcaucgacuacuacugguccgugcugaagcccggccagacccugcggaucaagagcgacgggaaccucaucgccccgugguacggccacauccugagcggcgagucccacgggcgcauccugaagaccgaccucaagcggggcagcugcaccguccagugccagacggagaagggcgggcugaacaccacccugcccuuccagaacguguccaaguacgccuucgggaacugcagcaaguacaucggcaucaagucccucaagcuggcggugggccugcgcaacguccccagccgguccagccgcggccucuucggggccaucgccggguucaucgagggcgggugguccggccugguggccggcugguacggguuccagcacagcaacgaccagggcguggggauggccgcggaccgggacuccacccagaaggccaucgacaagaucacgagcaaggucaacaacaucguggacaagaugaacaagcaguacgagaucaucgaccacgaguucuccgagguggagacccgccugaacaugaucaacaacaagaucgacgaccagauccaggacaucugggccuacaacgccgagcuccugguccugcucgagaaccagaagacccuggacgagcacgacgccaacgugaacaaccuguacaacaaggugaagcgggcgcucggcagcaacgccgucgaggacgggaagggcugcuucgagcuguaccacaagugcgacgaccagugcauggagaccauccgcaacggcacguacaaccgccggaaguaccaggaggaguccaagcuggagcgccagaagaucgagggggugaagcucgagagcgagggcaccuacaagauccugaccaucuacuccaccgucgccagcucccuggugaucgccaugggguucgccgcguuccucuucugggccaugagcaacggcagcugccggugcaacaucugcaucuga

SEQ ID NO: 73810 - RNA, 1683 nt, Artificial Sequence
  derived and/or modified sequence opt1 from hemagglutinin__InfluenzaA__AJD78211
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugagccuggaggggcgcgagugguccuacaucguggagcggcccagcgccgucaacggccucugcuaccccggcaacguggagaaccuggaggagcugcgcucccucuucagcuccgcccggagcuaccagcgcauccagaucuucccggacaccaucuggaacguguccuacgacgggaccagcaccgccugcuccggcagcuucuaccgguccaugcgcuggcugacccggaagaacggggacuaccccauccaggacgcgcaguacaccaacaaccagggcaagaacauccuguucaugugggggaucaaccacccgcccacggacaccacccagcgcgaccucuacacccggacggacaccaccaccagcgucgccacggaggagaucaaccgcaucuucaagccccugaucggcccccggccccuggugaacggccucauggggcgcaucgacuacuacugguccgugcugaagcccggccagacccugcggaucaagagcgacgggaaccucaucgccccgugguacggccacauccugagcggcgagucccacgggcgcauccugaagaccgaccucaagcggggcagcugcaccguccagugccagacggagaagggcgggcugaacaccacccugcccuuccagaacguguccaaguacgccuucgggaacugcagcaaguacaucggcaucaagucccucaagcuggcggugggccugcgcaacguccccagccggucccgccggggccucuucggggccaucgccggguucaucgagggcggguggagcggccugguggccggcugguacggguuccagcacuccaacgaccagggcguggggauggccgcggaccgcgacagcacccagaaggccaucgacaagaucacguccaaggucaacaacaucguggacaagaugaacaagcaguacgagaucaucgaccacgaguucagcgagguggagacccggcugaacaugaucaacaacaagaucgacgaccagauccaggacaucugggccuacaacgccgagcuccugguccugcucgagaaccagaagacccuggacgagcacgacgccaacgugaacaaccuguacaacaaggugaagcgcgcgcucggcuccaacgccgucgaggacgggaagggcugcuucgagcuguaccacaagugcgacgaccagugcauggagaccauccgcaacggcacguacaaccggcgcaaguaccaggaggagagcaagcuggagcggcagaagaucgagggggugaagcucgaguccgagggcaccuacaagauccugaccaucuacagcaccgucgccuccagccuggugaucgccaugggguucgccgcguuccucuucugggccauguccaacggcagcugccgcugcaacaucugcaucuga

SEQ ID NO: 73811 - RNA, 1689 nt, Artificial Sequence
  derived and/or modified sequence opt1 from hemagglutinin__InfluenzaA__AJI76401
auggccaucaucuaccugauccuccuguucgccaccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagccugaacgacuacgaggagcugaagcaccuccuguccagcgugaagcacuucgagaaggugcggauccugcccaaggaccgcuggacgaaccacaccaccaccgggggcuccaaggccugcgccgucagcgggaagcccuccuucuuccggaacaugguguggcucacgaagaagggccccaacuacccgguggcgaaggggagcuacaacaacaccuccggcgagcagaugcugaucaucuggggcguccaccaccccaucgacgaggccgagcagcgcgcccuguaccagaacguggggaccuacgugagcgccuccaccagcacgcucuacaagcgguccauccccgagaucgcggcccgccccgaggucaacggccuggggagccggauggaguucuccuggacccugcucgacgugugggacaccaucaacuucgagagcaccggcaaccugguggccccggaguacggcuucaagaucuccaagcgcgggagcagcggcaucaugaagacggaggggacccugggcaacugcgagaccaagugccagacgccccucggggccaucaacaccacccugcccuuccacaacguccacccccugaccaucggcgagugcccgaaguacgugaaguccgagaagcucgugcuggccaccggccugcggaacgucccccagaucgagagccgcggccucuucggggcgaucgccggguucaucgagggcggguggcagggcaugguggacggcugguacggguaccaccacuccaacgaccagggcagcggguacgccgccgacaaggaguccacgcagaaggccuucgacggcaucaccaacaaggugaacagcgucaucgagaagaugaacacccaguucgaggcgguggggaaggaguucaacaaccuggagaagcggcuggagaaccucaacaagcgcauggaggacggcuuccuggacguguggaccuacaacgccgagcugcucguccugauggagaacgagcggacgcuggacuuccacgacuccaacgugaagaaccucuacgagaagguccgcaugcagcugcgggacaacgugcgcgagcugggcaacgggugcuucgaguucuaccacaagugcgacgacgagugcaugaacagcgugaagaacggcaccuacgacuaccccaaguacgaggaggaguccaagcucaagcggaacgagaucaagggggucaagcugagcuccaugggcguguaccagauccuggccaucuacgccaccguggccggcagccucucccuggcgaucauggucgccgggaucagcuucuggaugugcuccaacggcagccugcagugccgcaucugcaucuga

SEQ ID NO: 73812 - RNA, 1701 nt, Artificial Sequence; identical to SEQ ID NO: 73073
  derived and/or modified sequence opt1 from hemagglutinin__InfluenzaA__AJI80137

SEQ ID NO: 73813 - RNA, 1701 nt, Artificial Sequence; identical to SEQ ID NO: 73073
  derived and/or modified sequence opt1 from hemagglutinin__InfluenzaA__AJI80149

SEQ ID NO: 73814 - RNA, 1701 nt, Artificial Sequence; identical to SEQ ID NO: 71048
  derived and/or modified sequence opt1 from hemagglutinin__InfluenzaA__AJI80161

SEQ ID NO: 73815 - RNA, 1701 nt, Artificial Sequence
  derived and/or modified sequence opt1 from hemagglutinin__InfluenzaA__AJI80172
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcucccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacccuggaguucaacaacgagagcuucaacugggccggggugacccagaacggcacguccagcgccugcauccggggguccaacagcuccuucuucagccgccugaacuggcucacccaccugaacuucaaguaccccgcgcugaacgugaccaugcccaacaacgagcaguucgacaagcucuacaucuggggcguccaccaccccgggaccgacaaggaccagaucuuccuguacgcccaguccagcggccggaucacggugagcaccaagcgcucccagcaggccgugaucccgaacaucggcagccggccccgcauccggaacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaagagcgagugcaucacgcccaacggguccauccccaacgacaagccguuccagaacgugaaccgcaucaccuacggcgcgugcccccgguacgugaagcagagcacccugaagcucgccaccgggaugcgcaacguccccgagaagcagacgcggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggcgugccagaagggcaacauccggugcaacaucugcaucuga

SEQ ID NO: 73816 - RNA, 1701 nt, Artificial Sequence
  derived and/or modified sequence opt1 from hemagglutinin__InfluenzaA__AJI80196
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaaggagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacaucaaccgcaucaccuacggcgcgugcccccgguacgugaagcaguccacccugaagcucgccacggggaugcgcaacgugcccgagaagcagacccggggcaucuucggggccaucgccggcuucaucgagaacggcugggaggggauggucgacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgaguuccucgucgcccuggagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcguggagcucaagagcggcuacaaggacuggauccuguggaucuccuucgccaucagcugcuuccugcucugcgucgcccugcugggguucaucaugugggcgugccagaagggcaacauccggugcaacaucugcaucuga

SEQ ID NO: 73817 - RNA, 1701 nt, Artificial Sequence; identical to SEQ ID NO: 73623
  derived and/or modified sequence opt1 from hemagglutinin__InfluenzaA__AJI80208

SEQ ID NO: 73818 - RNA, 1701 nt, Artificial Sequence; identical to SEQ ID NO: 71002
  derived and/or modified sequence opt1 from hemagglutinin__InfluenzaA__AJI80220

SEQ ID NO: 73819 - RNA, 1701 nt, Artificial Sequence; identical to SEQ ID NO: 73815
  derived and/or modified sequence opt1 from hemagglutinin__InfluenzaA__AJI80232

SEQ ID NO: 73820 - RNA, 1701 nt, Artificial Sequence; identical to SEQ ID NO: 71002
  derived and/or modified sequence opt1 from hemagglutinin__InfluenzaA__AJI80244

SEQ ID NO: 73821 - RNA, 1701 nt, Artificial Sequence; identical to SEQ ID NO: 70866
  derived and/or modified sequence opt1 from hemagglutinin__InfluenzaA__AJI80256

SEQ ID NO: 73822 - RNA, 1701 nt, Artificial Sequence; identical to SEQ ID NO: 71002
  derived and/or modified sequence opt1 from hemagglutinin__InfluenzaA__AJI80268

SEQ ID NO: 73823 - RNA, 1701 nt, Artificial Sequence
  derived and/or modified sequence opt1 from hemagglutinin__InfluenzaA__AJI80280
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucgggaagaucugcgacagcccccaccagauccucgacggcgagaacugcacccugaucgacgcccugcucggggacccccagugcgacggcuuccagaacaaggagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 73824 - RNA, 1701 nt, Artificial Sequence; identical to SEQ ID NO: 73595
  derived and/or modified sequence opt1 from hemagglutinin__InfluenzaA__AJI80292

SEQ ID NO: 73825 - RNA, 1701 nt, Artificial Sequence; identical to SEQ ID NO: 73623
  derived and/or modified sequence opt1 from hemagglutinin__InfluenzaA__AJI80303

SEQ ID NO: 73826 - RNA, 1701 nt, Artificial Sequence; identical to SEQ ID NO: 73595
  derived and/or modified sequence opt1 from hemagglutinin__InfluenzaA__AJI80315

SEQ ID NO: 73827 - RNA, 1701 nt, Artificial Sequence
  derived and/or modified sequence opt1 from hemagglutinin__InfluenzaA__AJI80326
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagaagaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcgccucgccaccggccugcggaacgucccgagcauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgcgagcucccuggugcucguggucagccugggggccaucagcuucuggaugugcuccaacggcagccugcagugccgcaucugcaucuga

SEQ ID NO: 73828 - RNA, 1701 nt, Artificial Sequence
  derived and/or modified sequence opt1 from hemagglutinin__InfluenzaA__AJI80337
augaaggccauccuggugguccuccuguacaccuucgccaccgcgaacgccgacacgcugugcaucggcuaccacgccaacaacagcaccgacaccguggacaccgugcucgagaagaacgucacggugacccacuccaucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagauguuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccacggccgaccagcagucccuguaccagaacgccaacgccuacgucuucgugggcaccagcaaguacuccaagaaguucaagcccgagaucgccauccggccgaaggugcgcgaccaggagggccggaugaacuacuacuggacccugaucgagcccggggacaagaucaccuucgaggcgacgggcaaccucgucgugccccgcuacgccuucgccauggagcggaacgccgggagcggcaucaucaucuccgacacccccgugcacgacugcaacacgaccugccagaccccggagggcgccaucaacaccagccugcccuuccagaacauccaccccaucaccaucgggaagugccccaaguacgucaaguccaccaagcugcgccucgcgacgggccugcggaacaucccgagcauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggcgaucuacuccaccgucgccagcucccuggugcucguggucagccugggggccaucagcuucuggaugugcuccaacggcagccugcagugccgcaucugcaucuga

SEQ ID NO: 73829 - RNA, 1701 nt, Artificial Sequence; identical to SEQ ID NO: 71002
  derived and/or modified sequence opt1 from hemagglutinin__InfluenzaA__AJI80348

SEQ ID NO: 73830 - RNA, 1701 nt, Artificial Sequence; identical to SEQ ID NO: 70866
  derived and/or modified sequence opt1 from hemagglutinin__InfluenzaA__AJI80360

SEQ ID NO: 73831 - RNA, 1701 nt, Artificial Sequence; identical to SEQ ID NO: 70866
  derived and/or modified sequence opt1 from hemagglutinin__InfluenzaA__AJI80372

SEQ ID NO: 73832 - RNA, 1701 nt, Artificial Sequence; identical to SEQ ID NO: 71048
  derived and/or modified sequence opt1 from hemagglutinin__InfluenzaA__AJI80384

SEQ ID NO: 73833 - RNA, 1701 nt, Artificial Sequence; identical to SEQ ID NO: 71048
  derived and/or modified sequence opt1 from hemagglutinin__InfluenzaA__AJI80395

SEQ ID NO: 73834 - RNA, 1701 nt, Artificial Sequence; identical to SEQ ID NO: 71048
  derived and/or modified sequence opt1 from hemagglutinin__InfluenzaA__AJI80406

SEQ ID NO: 73835 - RNA, 1701 nt, Artificial Sequence; identical to SEQ ID NO: 71048
  derived and/or modified sequence opt1 from hemagglutinin__InfluenzaA__AJI80417

SEQ ID NO: 73836 - RNA, 1701 nt, Artificial Sequence; identical to SEQ ID NO: 71048
  derived and/or modified sequence opt1 from hemagglutinin__InfluenzaA__AJI80428

SEQ ID NO: 73837 - RNA, 1701 nt, Artificial Sequence; identical to SEQ ID NO: 71002
  derived and/or modified sequence opt1 from hemagglutinin__InfluenzaA__AJI80439

SEQ ID NO: 73838 - RNA, 1701 nt, Artificial Sequence; identical to SEQ ID NO: 71002
  derived and/or modified sequence opt1 from hemagglutinin__InfluenzaA__AJI80462

SEQ ID NO: 73839 - RNA, 1701 nt, Artificial Sequence
  derived and/or modified sequence opt1 from hemagglutinin__InfluenzaA__AJI80474
augaaggccauccuggugguccuccuguacaccuucgccaccgcgaacgccgacacgcugugcaucggcuaccacgccaacaacagcaccgacaccguggacaccgugcucgagaagaacgucacggugacccacuccaucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcugucccagagcuacaucaacgacaagggcaaggaggugcuggugcucugggggauccaccaccccagcaccacggccgaccagcagucccuguaccagaacgccgacgccuacgucuucgugggcaccagccgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 73840 - RNA, 1701 nt, Artificial Sequence; identical to SEQ ID NO: 73839
  derived and/or modified sequence opt1 from hemagglutinin__InfluenzaA__AJI80485

SEQ ID NO: 73841 - RNA, 1701 nt, Artificial Sequence; identical to SEQ ID NO: 71048
  derived and/or modified sequence opt1 from hemagglutinin__InfluenzaA__AJI80496

SEQ ID NO: 73842 - RNA, 1701 nt, Artificial Sequence; identical to SEQ ID NO: 73651
  derived and/or modified sequence opt1 from hemagglutinin__InfluenzaA__AJI80507

SEQ ID NO: 73843 - RNA, 1701 nt, Artificial Sequence; identical to SEQ ID NO: 71048
  derived and/or modified sequence opt1 from hemagglutinin__InfluenzaA__AJI80518

SEQ ID NO: 73844 - RNA, 1701 nt, Artificial Sequence; identical to SEQ ID NO: 69140
  derived and/or modified sequence opt1 from hemagglutinin__InfluenzaA__AJJ98765

SEQ ID NO: 73845 - RNA, 1701 nt, Artificial Sequence
  derived and/or modified sequence opt1 from hemagglutinin__InfluenzaA__AJJ98777
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuucuccaccggggagaucugcaacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73846 - RNA, 1701 nt, Artificial Sequence; identical to SEQ ID NO: 70461
  derived and/or modified sequence opt1 from hemagglutinin__InfluenzaA__AJJ98789

SEQ ID NO: 73847 - RNA, 1701 nt, Artificial Sequence
  derived and/or modified sequence opt1 from hemagglutinin__InfluenzaA__AJJ98801
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcaacaaggccuacuccaacugcuaccccuacgacgugccggacuacgcgagccugcggucccucgucgccagcuccggcacccuggaguucaacaacgagagcuucaacuggacgggggugacccagaacggcaccuccagcgccugcauccgccgguccaacaacagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcucccagcaggccgugaucccgaacaucggcagccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 73848 - RNA, 1701 nt, Artificial Sequence
  derived and/or modified sequence opt1 from hemagglutinin__InfluenzaA__AJJ98813
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccguggucccgaacaucggcucccgcccccggauccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgucaagcaguccacgcugaagcucgcgaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 73849 - RNA, 1701 nt, Artificial Sequence
  derived and/or modified sequence opt1 from hemagglutinin__InfluenzaA__AJJ98825
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgccaccggauccgcaacauccccucccggaucagcaucuacuggacgaucgucaagcccggcgacauccugcucaucaacuccaccgggaaccugaucgcgccccgcggcuacuucaagauccggagcgggaaguccagcaucaugcgcuccgacgccccgaucggcaagugcaagagcgagugcaucacccccaacggcuccauccccaacgacaagcccuuccagaacgugaaccggaucaccuacggggccugcccgcgcuacgugaagcagagcacgcugaagcucgccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73850 - RNA, 1701 nt, Artificial Sequence
  derived and/or modified sequence opt1 from hemagglutinin__InfluenzaA__AJJ98837
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagagcacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 73851 - RNA, 1701 nt, Artificial Sequence
  derived and/or modified sequence opt1 from hemagglutinin__InfluenzaA__AJJ98849
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggcugcgcguccggaacauccccucccgcgugagcaucuacuggaccaucgugaagcccggcgacauccuccugaucaacuccaccgggaaccugaucgcgccccggggcuacuucaagauccgcagcgggaaguccagcaucaugcgguccgacgccccgaucggcaagugcaacagcgccugcaucacccccaacggcuccauccccaacgacaagcccuuccagaacgucaaccgcaucacguacggggccugcccgcgguacgugaagcagaacacccucaagcuggccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcgcucgagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcgcuccugggcuucaucaugugggccugccagaaggggaacauccggugcaacaucugcaucuga

SEQ ID NO: 73852 - RNA, 1701 nt, Artificial Sequence
  derived and/or modified sequence opt1 from hemagglutinin__InfluenzaA__AJJ98861
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugaaguccgacgcccccaucgggaagugcaacagcgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73853 - RNA, 1701 nt, Artificial Sequence
  derived and/or modified sequence opt1 from hemagglutinin__InfluenzaA__AJJ98873
augaagaccaucaucgcccugagcuacucccucugccugguguucgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgcaagagcaacaacuccuucuucagccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcgcaucaccgugagcacgaagcggagccagcagaccgugaucccgaacaucggcucccgcccccggguccgcaacauccccagccggaucuccaucuacuggaccaucgugaagcccggcgacauccugcucaucaacagcaccgggaaccugaucgccccgcgcggcuacuucaagauccgguccggcaagagcuccaucaugcgcagcgacgcccccaucgggaagugcaacuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73854 - RNA, 1701 nt, Artificial Sequence
  derived and/or modified sequence opt1 from hemagglutinin__InfluenzaA__AJJ98885
augaagaccaucaucgcccugagcaacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaaggagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 73855 - RNA, 1701 nt, Artificial Sequence
  derived and/or modified sequence opt1 from hemagglutinin__InfluenzaA__AJJ98897
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagguggaccuguggagcuacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 73856 - RNA, 1701 nt, Artificial Sequence; identical to SEQ ID NO: 72778
  derived and/or modified sequence opt1 from hemagglutinin__InfluenzaA__AJJ98909

SEQ ID NO: 73857 - RNA, 1701 nt, Artificial Sequence
  derived and/or modified sequence opt1 from hemagglutinin__InfluenzaA__AJJ98921
augaagaccaucaucgcccugagcuacauccucugccugguguucgcccagaagcugcccggcaaggacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugaagcagaacggcaccuccagcgccugcauccgccgguccaacagcuccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccgugagcaccaagcgcucccagcaggccgugaucccgaacaucggcagccggccccgcauccggaacauccccucccgcaucagcaucuacuggacgaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgugaagcagagcacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagacgaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 73858 - RNA, 1701 nt, Artificial Sequence; identical to SEQ ID NO: 70461
  derived and/or modified sequence opt1 from hemagglutinin__InfluenzaA__AJJ98933

SEQ ID NO: 73859 - RNA, 1701 nt, Artificial Sequence; identical to SEQ ID NO: 67990
  derived and/or modified sequence opt1 from hemagglutinin__InfluenzaA__AJJ98945

SEQ ID NO: 73860 - RNA, 1701 nt, Artificial Sequence
  derived and/or modified sequence opt1 from hemagglutinin__InfluenzaA__AJJ98957
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcacagcaaguucaaguaccccgcccugaacgugaccaugcccaacaacgagcaguucgacaagcuguacaucuggggcguccaccaccccgggaccgacaacgaccagaucuuccucuacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 73861 - RNA, 1701 nt, Artificial Sequence; identical to SEQ ID NO: 63442
  derived and/or modified sequence opt1 from hemagglutinin__InfluenzaA__AJJ98969

SEQ ID NO: 73862 - RNA, 1701 nt, Artificial Sequence
  derived and/or modified sequence opt1 from hemagglutinin__InfluenzaA__AJJ98981
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccacauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacguccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgucaagcaguccacgcugaagcucgcgaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacgucuaccgcgacgaggcccucaacaaccgguuccagaucaaggggguggagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 73863 - RNA, 1701 nt, Artificial Sequence
  derived and/or modified sequence opt1 from hemagglutinin__InfluenzaA__AJJ98993
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacaacccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggacgggggugacccagaacggcaccuccagcgccugcaugcgccgguccaacagcuccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccguguccaccaagcgcagccagcaggccgugaucccgaacaucggcagccggccccgcauccggaacauccccucccgcaucagcaucuacuggacgaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgugaagcagagcacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 73864 - RNA, 1701 nt, Artificial Sequence
  derived and/or modified sequence opt1 from hemagglutinin__InfluenzaA__AJJ99005
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaucggggugacccagaacggcaccuccagcgccugcauccgccgguccaacaacagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccagcgggcggaucaccguguccaccaagcgcagccagcaggccgugaucccgaacaucggcagccggccccgcguccggaacauccccucccgcgugagcaucuacuggacgaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucaccuacggggccugcccccgguacgugaagcagaacacgcugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagacgaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 73865 - RNA, 1701 nt, Artificial Sequence; identical to SEQ ID NO: 64419
  derived and/or modified sequence opt1 from hemagglutinin__InfluenzaA__AJJ99017

SEQ ID NO: 73866 - RNA, 1701 nt, Artificial Sequence
  derived and/or modified sequence opt1 from hemagglutinin__InfluenzaA__AJJ99029
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucaucgagcgcagcaaggccuacuccaacugcuaccccuacgacgugccggacuacgcgagccugcggucccucguggccagcuccggcacgcuggaguucaacaacgagagcuucaacuggaccggggucacccagaacggcaccuccagcuccugcauccgccggagcaacaacuccuucuucagccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcccaggcguccgggcggaucaccgucagcacgaagcgcagccagcagaccgugaucccgaacaucggcucccggccccgcgugcggaacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgugaagcagaacacccugaagcucgccaccggcaugcgcaacguccccgagaagcagacgcgggggaucuucggcgcgaucgccggguucaucgagaacggcugggagggcaugguggacgggugguacggcuuccgccaccagaacuccgaggggcggggccaggccgccgaccucaagagcacccaggccgcgaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacaacguguaccgggacgaggcgcucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 73867 - RNA, 1701 nt, Artificial Sequence
  derived and/or modified sequence opt1 from hemagglutinin__InfluenzaA__AJJ99041
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgcggguccgacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuucccguacgcgcaggccagcggccgcaucaccguguccacgaagcggagccagcagaccgugauccccaacaucggcagccgcccccggguccgcaacauccccucccggaucagcaucuacuggaccaucgugaagccgggggacauccugcugaucaacuccaccggcaaccucaucgcgccccgcggguacuucaagauccggagcggcaaguccagcaucaugcgcuccgacgcccccaucggcaagugcaacagcgggugcaucacgcccaacggcuccaucccgaacgacaagcccuuccagaacgugaaccggaucaccuacggggccugcccccgcuacgucaagcagagcacccugaagcuggccaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagagcacccaggcggccaucaaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaagggcguggagcucaaguccggguacaaggacuggauccuguggaucagcuucgccaucuccugcuuccugcucugcguggcccugcugggcuucaucaugugggccugccagaaggggaacauccgcugcaacaucugcaucuga

SEQ ID NO: 73868 - RNA, 1701 nt, Artificial Sequence; identical to SEQ ID NO: 70866
  derived and/or modified sequence opt1 from hemagglutinin__InfluenzaA__AJJ99053

SEQ ID NO: 73869 - RNA, 1701 nt, Artificial Sequence; identical to SEQ ID NO: 70866
  derived and/or modified sequence opt1 from hemagglutinin__InfluenzaA__AJJ99065

SEQ ID NO: 73870 - RNA, 1701 nt, Artificial Sequence
  derived and/or modified sequence opt1 from hemagglutinin__InfluenzaA__AJJ99089
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcggaacaaggccuacuccaacugcuaccccuacgacgugccggacuacgcgagccugcgcucccucgucgccagcuccggcacccuggaguucaacaacgagagcuucaacuggacgggggugacccagaacggcaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73871 - RNA, 1701 nt, Artificial Sequence; identical to SEQ ID NO: 70556
  derived and/or modified sequence opt1 from hemagglutinin__InfluenzaA__AJJ99101

SEQ ID NO: 73872 - RNA, 1701 nt, Artificial Sequence; identical to SEQ ID NO: 70461
  derived and/or modified sequence opt1 from hemagglutinin__InfluenzaA__AJJ99113

SEQ ID NO: 73873 - RNA, 1701 nt, Artificial Sequence
  derived and/or modified sequence opt1 from hemagglutinin__InfluenzaA__AJJ99125
augaagaccaucaucgcccugagcuacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcaacagcccccaccagauccuggacggcgagaacugcacccucaucgacgcccugcugggggacccccagugcgacggcuuccagaacaagaagugggaccucuucguggagcgcagcaaggcccacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccagcaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcagccagcaggccgugaucccgaacaucggcucccggccccgcguccggaacauccccagccgcguguccaucuacuggaccaucgugaagcccggcgacauccugcugaucaacagcaccgggaaccucaucgccccgcggggcuacuucaagauccgcuccgggaaguccuccaucaugcggagcgacgcccccaucggcaagugcaacuccgcgugcaucacccccaacggcagcauccccaacgacaagccguuccagaacgucaaccgcaucacguacggggccugcccccgguacgugaagcagaacacccugaagcuggccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgagguggagggccggauccaggaccucgagaaguacguggaggacaccaagaucgaccuguggagcuacaacgccgagcugcucgucgcgcuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggagcauccgcaacggcaccuacgaccacgacguguaccgggacgaggcccugaacaaccgcuuccagaucaaggggguggagcucaaguccggcuacaaggacuggauccuguggaucagcuucgccaucuccugcuuccugcucugcgucgcgcugcugggcuucaucaugugggccugccagaaggggaacauccggugcaacaucugcaucuga

SEQ ID NO: 73874 - RNA, 1701 nt, Artificial Sequence
  derived and/or modified sequence opt1 from hemagglutinin__InfluenzaA__AJJ99137
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucguguccauccgcaacgggaccuacgaccacgacguguaccgggacgaggcccucaacaaccgcuuccagaucaagggcgucgagcugaaguccggguacaaggacuggauccuguggaucuccuucgccaucagcugcuuccuccugugcguggcgcugcucggcuucaucaugugggccugccagaagggcaacauccggugcaacaucugcaucuga

SEQ ID NO: 73875 - RNA, 1701 nt, Artificial Sequence
  derived and/or modified sequence opt1 from hemagglutinin__InfluenzaA__AJJ99149
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcaagaacugcacccucaucgacgcccugcugggggacccccagugcgacggcuuccagaacaagaagugggaccucuucguggagcgcagcaaggccuacuccaacugcuaccccuacgacaugccggacuacgcgagccugcggucccugguggccagcuccggcacgcucgaguucaacaacgagagcuucaacuggaccggggucacccagaacggcaccuccagcgccugcauccgccgguccaacagcuccuucuucagccgccugaacuggcugacgcaccucaacuucaaguaccaggcccugaacgugaccaugcccaacaacgagcaguucgacaagcuguacaucuggggcgugcaccaccccgggaccgacaaggaccagaucuuccucuacgcgcaggccuccgggcggaucaccgucagcacgaagcgcagccagcagaccgugauccccaacaucggcucccggccgcgcgugcggaacauccccagccgcaucuccaucuacuggaccaucgucaagcccggcgacauccugcugaucaacagcaccgggaaccucaucgcgccccggggcuacuucaagauccaguccgggaaguccuccaucaugcgcagcgacgccccgaucggcaagugcaacuccgagugcaucacgcccaacggcagcauccccaacgacaagcccuuccagaacgugaaccggaucaccuacggggccugcccgcgcuacgugaagcagaacacccugaagcuggccaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 73876 - RNA, 1701 nt, Artificial Sequence
  derived and/or modified sequence opt1 from hemagglutinin__InfluenzaA__AJJ99161
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccgggacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 73877 - RNA, 1701 nt, Artificial Sequence
  derived and/or modified sequence opt1 from hemagglutinin__InfluenzaA__AJJ99173
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuuccgcaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 73878 - RNA, 1701 nt, Artificial Sequence
  derived and/or modified sequence opt1 from hemagglutinin__InfluenzaA__AJJ99185
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcaaguccaacaacagcuucuucucccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcgccgacgcccccaucggcaagugcaacuccgagugcaucacgcccaacggcagcauccccaacgacaagccguuccagaacgugaaccggaucaccuacggggcgugcccccgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgcggaccugaaguccacccaggccgccaucgaccagaucaacgggaagcugaaccggcucaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgcggaggacauggggaacggcugcuucaagaucuaccacaagugcgacaacgccugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 73879 - RNA, 1701 nt, Artificial Sequence; identical to SEQ ID NO: 69816
  derived and/or modified sequence opt1 from hemagglutinin__InfluenzaA__AJJ99197

SEQ ID NO: 73880 - RNA, 1701 nt, Artificial Sequence
  derived and/or modified sequence opt1 from hemagglutinin__InfluenzaA__AJJ99209
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccgacaacagcuucuucucccggcugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcggccgcaucaccguguccacgaagcggagccagcagaccgugaucccgaacaucggcagccgcccccggguccgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgugaaccggaucaccuacggcgccugcccccgcuacgucaagcagagcacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucaaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggaccuacgaccacgacgucuaccgcgacgaggcccucaacaaccgguuccagaucaagggcguggagcugaaguccggcuacaaggacuggauccuguggaucagcuucgccauguccugcuuccuccugugcguggcccugcucggguucaucaugugggccugccagaagggcaacauccgcugcaacaucugcaucuga

SEQ ID NO: 73881 - RNA, 1701 nt, Artificial Sequence
  derived and/or modified sequence opt1 from hemagglutinin__InfluenzaA__AJJ99221
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccaguccgggaaguccuccaucaugcgcagcgacgcccccaucggcaagugcaacuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 73882 - RNA, 1701 nt, Artificial Sequence; identical to SEQ ID NO: 62923
  derived and/or modified sequence opt1 from hemagglutinin__InfluenzaA__AJJ99233

SEQ ID NO: 73883 - RNA, 1701 nt, Artificial Sequence
  derived and/or modified sequence opt1 from hemagglutinin__InfluenzaA__AJJ99244
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccggcagcgacaacggcacgugcuaccccggggacuucaucgacuacgaggagcugcgggagcagcucuccagcguguccagcuucgagcgcuucgagaucuuccccaagaccuccagcuggcccaaccacgacuccaacaagggcgucaccgccgccugcccgcacgccggggcgaagggcuucuacaagaaccugaucuggcuggugaagaaggggaacagcuaccccaagcucuccaagagcuacaucaacgacaagggcaaggaggugcugguccuguggggcauccaccaccccuccaccacggccgaccagcagagccucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccggcagcgggaucaucaucuccgacacccccgugcacgacugcaacaccacgugccagaccccgaagggcgccaucaacaccagccuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcagcggcuacgccgccgaccugaaguccacccagaacgccaucgacaagaucacgaacaaggugaacagcgucaucgagaagaugaacacccaguucaccgcgguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgccaucuacuccaccgucgcgagcucccuggugcugguggucagccucggcgccaucuccuucuggaugugcagcaacgggagccugcagugccggaucugcaucuga

SEQ ID NO: 73884 - RNA, 1701 nt, Artificial Sequence
  derived and/or modified sequence opt1 from hemagglutinin__InfluenzaA__AJJ99255
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaaccacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcgggccggcgcgaaguccuucuacaagaaccugaucuggcucgugaagaaggggaacagcuaccccaagcuguccaagagcuacaucaacgacaagggcaaggaggugcuggucaugugggggauccaccaccccagcaccacggccgaccagcagucccucuaccagaacgccgacgccuacguguucgugggcaccagccgcuacuccaaggaguucaagcccgagaucgccauccggccgaagguccgcgaccaggagggccggaugaacuacuacuggacccugguggagcccggggacaagaucaccuucgaggcgacgggcaaccugcucgugccccgcuacgccuucgccauggagcggaacgccgggagcggcaucaucaucuccgacacccccguccacgacugcaacacgaccugccagaccccgaagggcgccaucaacaccagccugcccuuccagaacauccaccccaucaccaucgggaagugccccaaguacgugaaguccaccaagcugcgccucgcgacgggccugcggaacgugccgagcauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcucccugguccucguggugagccugggggccaucagcuucuggaugugcuccaacggcagccugcagugccgcaucugcaucuga

SEQ ID NO: 73885 - RNA, 1698 nt, Artificial Sequence
  derived and/or modified sequence opt1 from hemagglutinin__InfluenzaA__AJJ99267
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacgaucaccggggucuccgccagcugcucccacaacggcgagagcuccuucuaccgcaaccugcuguggcucaccgggaagaacggccuguaccccaaccugagcaaguccuacgccaacaacaaggagaaggaggugcucgugcuguggggcguccaccacccgcccaacaucggcgaccagaaggcccuguaccacaccgagaacgccuacgugagcguggucagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucacgaacaaggugaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcugguccuccuggagaacgagcggacgcuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacagcaccgucgccagcucccuggugcuccuggugagccugggggccgucuccuucuggaugugcagcaacggcucccuccagugccgggugugcaucuga

SEQ ID NO: 73886 - RNA, 1701 nt, Artificial Sequence; identical to SEQ ID NO: 68058
  derived and/or modified sequence opt1 from hemagglutinin__InfluenzaA__AJJ99278

SEQ ID NO: 73887 - RNA, 1701 nt, Artificial Sequence; identical to SEQ ID NO: 68061
  derived and/or modified sequence opt1 from hemagglutinin__InfluenzaA__AJJ99289

SEQ ID NO: 73888 - RNA, 1698 nt, Artificial Sequence
  derived and/or modified sequence opt1 from hemagglutinin__InfluenzaA__AJJ99301
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagagccucaucuccaaggagagcugguccuacaucguggagaagcccaaccccgagaacgggaccugcuaccccggccacuucgccgacuacgaggagcugcgcgagcagcugagcuccgugagcuccuucgagcgguucgagaucuucccgaaggagagcuccuggcccaaccacacggucaccggggugagcgccuccugcagccacaacggcgaguccagcuucuaccgcaaccuccuguggcugaccgggaagaacggccucuaccccaaccuguccaagagcuacgccaacaacaaggagaaggaggugcugguccucuggggcgugcaccacccgcccaacaucggcgaccagaaggcccuguaccacaccgagaacgccuacgugagcgucguguccagccacuacucccggaaguucacgcccgagaucgccaagcgccccaaggugcgggaccaggagggccgcaucaacuacuacuggacccugcucgagcccggggacaccaucaucuucgaggcgaacggcaaccugaucgccccgcgguacgccuucgcccugagccgcggguucggcuccggcaucaucaacagcaacgcccccauggacaagugcgacgcgaagugccagacgccccagggggccaucaacuccagccuccccuuccagaacguccacccggugaccaucggcgagugccccaaguacgugcgguccgccaagcugcgcauggucaccgggcugcggaacauccccagcauccagucccgcggccucuucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccugaacaagaaggucgacgacggcuucaucgacaucuggaccuacaacgccgagcuccuggugcugcucgagaacgagcggacgcuggacuuccacgacuccaacgugaagaaccuguacgagaaggucaagagccagcucaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcuggagagcaugggcgucuaccagauccucgccaucuacagcaccguggccuccagccuggugcugcucgucucccugggggccaucagcuucuggaugugcuccaacggcagccugcagugccggaucugcaucuga

SEQ ID NO: 73889 - RNA, 1698 nt, Artificial Sequence
  derived and/or modified sequence opt1 from hemagglutinin__InfluenzaA__AJJ99324
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaaguccggccuguaccccaaccugagcaaguccuacgccaacaacaaggagaaggaggugcucguccuguggggcgugcaccacccgcccaacaucgccgaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacagcaccguggccagcucccuggugcuccuggucagccugggcgccaucuccuucuggaugugcagcaacgggucccuccagugccggaucugcaucuga

SEQ ID NO: 73890 - RNA, 1701 nt, Artificial Sequence
  derived and/or modified sequence opt1 from hemagglutinin__InfluenzaA__AJJ99335
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccaacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaacggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 73891 - RNA, 1701 nt, Artificial Sequence; identical to SEQ ID NO: 65793
  derived and/or modified sequence opt1 from hemagglutinin__InfluenzaA__AJJ99357

SEQ ID NO: 73892 - RNA, 1701 nt, Artificial Sequence; identical to SEQ ID NO: 67832
  derived and/or modified sequence opt1 from hemagglutinin__InfluenzaA__AJJ99368

SEQ ID NO: 73893 - RNA, 1701 nt, Artificial Sequence; identical to SEQ ID NO: 67443
  derived and/or modified sequence opt1 from hemagglutinin__InfluenzaA__AJJ99379

SEQ ID NO: 73894 - RNA, 1701 nt, Artificial Sequence
  derived and/or modified sequence opt1 from hemagglutinin__InfluenzaA__AJJ99390
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 73895 - RNA, 1701 nt, Artificial Sequence; identical to SEQ ID NO: 65793
  derived and/or modified sequence opt1 from hemagglutinin__InfluenzaA__AJJ99401

SEQ ID NO: 73896 - RNA, 1698 nt, Artificial Sequence
  derived and/or modified sequence opt1 from hemagglutinin__InfluenzaA__AJJ99413
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgccuccauggacaagugcgacgcgaagugccagacgccccagggcgccaucaacagcucccugcccuuccagaacguccaccccgugaccaucggggagugcccgaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacagcaccguggccagcucccuggugcuccuggucagccugggcgccaucuccuucuggaugugcagcaacgggucccuccagugccggaucugcaucuga

SEQ ID NO: 73897 - RNA, 1698 nt, Artificial Sequence; identical to SEQ ID NO: 64634
  derived and/or modified sequence opt1 from hemagglutinin__InfluenzaA__AJJ99425

SEQ ID NO: 73898 - RNA, 1698 nt, Artificial Sequence
  derived and/or modified sequence opt1 from hemagglutinin__InfluenzaA__AJJ99437
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccucccugagcaaguccuacgccaacaacaaggagaaggaggugcucguccuguggggcgugcaccacccgcccaacaucgccgaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacagcaccguggccagcucccuggugcuccuggucagccugggcgccaucuccuucuggaugugcagcaacgggucccuccagugccggaucugcaucuga

SEQ ID NO: 73899 - RNA, 1698 nt, Artificial Sequence
  derived and/or modified sequence opt1 from hemagglutinin__InfluenzaA__AJJ99449
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggggaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccaaggagagcaagcugaaccgcgagaagaucgacggcgugaagcucgaguccaugggggucuaccagauccuggccaucuacagcaccguggccagcucccuggugcuccuggucagccugggcgccaucuccuucuggaugugcagcaacgggucccuccagugccggaucugcaucuga

SEQ ID NO: 73900 - RNA, 1698 nt, Artificial Sequence; identical to SEQ ID NO: 63496
  derived and/or modified sequence opt1 from hemagglutinin__InfluenzaA__AJJ99461

SEQ ID NO: 73901 - RNA, 1701 nt, Artificial Sequence
  derived and/or modified sequence opt1 from hemagglutinin__InfluenzaA__AJJ99483
augaaggccauccugcucgugcugcuguacaccuucgccaccgcgaacgccgacacgcucugcaucggcuaccacgccaacaacagcaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucaacuacgaggagcugcgggagcagcugagcuccgugagcuccuucgagcgcuucgagaucuuccccaagaccagcuccuggcccaaccacgacagcaacaagggggugaccgccgccugcccgcgggccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccacggccgaccagcagucccuguaccagaacgccgacgccuacgucuucgugggcaccagccgcuacuccaagaaguucaagcccgagaucgccauccggccgaaggugcgcgaccaggagggccggaugaacuacuacuggacccucgucgagcccggggacaagaucaccuucgaggcgacgggcaaccugcuggugccccgcuacgccuucgccauggagcggaacgccgggagcggcaucaucaucuccgacacccccgugcacgacugcaacacgaccugccagaccccgaagggcgccaucaacaccagccuccccuuccagaacauccaccccaucaccaucgggaagugccccaaguacgucaaguccaccaagcugcgccuggcgacgggccuccggaacgugccgagcauccagucccgcgggcuguucggcgccaucgccggguucaucgagggcggcuggaccgggaugguggacggcugguacggguaccaccaccagaacgagcagggcagcggguacgccgccgaccugaaguccacccagaacgcgaucgacaagaucaccaacaaggucaacagcgugaucgagaagaugaacacgcaguucaccgccgugggcaaggaguucaaccaccucgagaagcggaucgagaaccugaacaagaaggucgacgacggcuuccuggacaucuggaccuacaacgccgagcuccuggugcugcucgagaacgagcgcacccuggacuaccacgacuccaacgucaagaaccuguacgagaaggugcggaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcuggagagcacccggaucuaccagauccucgcgaucuacuccaccguggccagcucccuggugcuggucgugagccucggggccaucagcuucuggaugugcuccaacggcagccugcagugccgcaucugcaucuga

SEQ ID NO: 73902 - RNA, 1701 nt, Artificial Sequence; identical to SEQ ID NO: 68061
  derived and/or modified sequence opt1 from hemagglutinin__InfluenzaA__AJJ99494

SEQ ID NO: 73903 - RNA, 1701 nt, Artificial Sequence
  derived and/or modified sequence opt1 from hemagglutinin__InfluenzaA__AJJ99505
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaagggcuucaaccaccuggagaagcggaucgagaaccucaacaagaaggucgacgacggguuccuggacaucuggaccuacaacgccgagcugcucgugcugcuggagaacgagcgcacccucgacuaccacgacagcaacgugaagaaccuguacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcucaaccgcgaggagaucgacggggugaagcuggagagcacccggaucuaccagauccuggcgaucuacuccaccgucgccagcagccucgugcugguggucucccugggcgccaucagcuucuggaugugcuccaacggcagccuccagugccgcaucugcaucuga

SEQ ID NO: 73904 - RNA, 1701 nt, Artificial Sequence; identical to SEQ ID NO: 63919
  derived and/or modified sequence opt1 from hemagglutinin__InfluenzaA__AJJ99516

SEQ ID NO: 73905 - RNA, 1701 nt, Artificial Sequence
  derived and/or modified sequence opt1 from hemagglutinin__InfluenzaA__AJJ99527
augaaggccauccugcucgugcugcuguacaccuucgccaccgcgaacgccgacacgcucugcaucggcuaccacgccaacaacagcaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucaacuacgaggagcugcgggagcagcugagcuccgugagcuccuucgagcgcuucgagaucuuccccaagaccagcuccuggcccaaccacgacagcaacaagggggugaccgccgccugcccgcgggccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccacggccgaccagcagucccuguaccagaacgccgacgccuacgucuucgugggcaccagccgcuacuccaagaaguucaagcccgagaucgccauccggccgaaggugcgcgaccaggagggccggaugaacuacuacuggacccucgucgagcccggggacaagaucaccuucgaggcgacgggcaaccugcuggugccccgcuacgccuucgccauggagcggaacgccgggagcggcaucaucaucuccgacacccccgugcacgacugcaacacgaccugccagaccccgaagggcgccaucaacaccagccuccccuuccagaacauccaccccaucaccaucgggaagugccccaaguacgucaaguccaccaagcugcgccuggcgacgggccuccggaacgugccgagcauccagucccgcgggcuguucggcgccaucgccggguucaucgagggcggcuggaccgggaugguggacggcugguacggguaccaccaccagaacgagcagggcagcggguacgccgccgaccugaaguccacccagaacgucaucgacaagaucaccaacaaggugaacagcgugaucgagaagaugaacacgcaguucaccgcggucggcaaggaguucaaccaccucgagaagcggaucgagaaccugaacaagaagguggacgacggcuuccuggacaucuggaccuacaacgccgagcuccugguccugcucgagaacgagcgcacccuggacuaccacgacuccaacgugaagaaccuguacgagaaggugcggaaccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcuggagagcacccggaucuaccagauccucgccaucuacuccaccguggcgagcucccugguccugguggugagccucggggccaucagcuucuggaugugcuccaacggcagccugcagugccgcaucugcaucuga

SEQ ID NO: 73906 - RNA, 1701 nt, Artificial Sequence
  derived and/or modified sequence opt1 from hemagglutinin__InfluenzaA__AJJ99538
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73907 - RNA, 1701 nt, Artificial Sequence
  derived and/or modified sequence opt1 from hemagglutinin__InfluenzaA__AJJ99549
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacaugugcauggaguccgugaagaacggcaccuacgacuaccccaaguacagcgaggaggccaagcugaaccgggaggagaucgacggggugaagcucgaguccacccgcaucuaccagauccuggccaucuacagcaccgcggccuccagccugguccucguggugucccugggcgccaucagcuucuggaugugcagcaacggcucccugcagugccggaucugcaucuga

SEQ ID NO: 73908 - RNA, 1701 nt, Artificial Sequence; identical to SEQ ID NO: 68097
  derived and/or modified sequence opt1 from hemagglutinin__InfluenzaA__AJJ99560

SEQ ID NO: 73909 - RNA, 1701 nt, Artificial Sequence
  derived and/or modified sequence opt1 from hemagglutinin__InfluenzaA__AJJ99571
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacauccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73910 - RNA, 1701 nt, Artificial Sequence
  derived and/or modified sequence opt1 from hemagglutinin__InfluenzaA__AJJ99582
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 73911 - RNA, 1701 nt, Artificial Sequence; identical to SEQ ID NO: 63919
  derived and/or modified sequence opt1 from hemagglutinin__InfluenzaA__AJJ99593

SEQ ID NO: 73912 - RNA, 1701 nt, Artificial Sequence
  derived and/or modified sequence opt1 from hemagglutinin__InfluenzaA__AJJ99604
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgcggguccgcgaccaggagggccggaugaacuacuacuggacccugguggagcccggggacaagaucaccuucgaggcgaccggcaaccucguggucccccgcuacgccuucgccauggagcgggacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaagaucgacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 73913 - RNA, 1698 nt, Artificial Sequence
  derived and/or modified sequence opt1 from hemagglutinin__InfluenzaA__AJJ99616
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccaaccagaagacccuguaccacacggagaacgccuacguguccgucgugagcagccacuacucccggaagcucacccccgagaucgccaagcgccccaaggugcgggaccaggagggccgcaucaacuacuacuggacccugcuggagcccggcgacaccaucaucuucgaggcgaacgggaaccucaucgccccgcgguacgccuucgcccugagccgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcuccgcauggucaccggccugcggaacauccccagcauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcucgagcggcgcauggagaaccugaacaagaaggucgacgacggguucaucgacaucuggacguacaacgccgagcugcucgugcugcuggagaacgagcggacccucgacuuccacgacuccaacgugaagaaccuguacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcucaaccgcgagaagaucgacggggugaagcuggagagcaugggcgucuaccagauccuggccaucuacuccaccguggccagcagccucgugcugcuggucucccucggcgccaucagcuucuggaugugcuccaacgggagccugcagugccggaucugcaucuga

SEQ ID NO: 73914 - RNA, 1698 nt, Artificial Sequence; identical to SEQ ID NO: 64634
  derived and/or modified sequence opt1 from hemagglutinin__InfluenzaA__AJJ99628

SEQ ID NO: 73915 - RNA, 1698 nt, Artificial Sequence
  derived and/or modified sequence opt1 from hemagglutinin__InfluenzaA__AJJ99640
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccaaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccguggccggguucaucgagggcggcuggaccgggaugguggacggcugguacggguaccaccaccagaacgagcagggcagcggguacgcggccgaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacuccaacgucaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggccaucuacuccaccguggccagcagccugguccuccuggugucccugggcgccaucagcuucuggaugugcuccaacgggagccuccagugccggaucugcaucuga

SEQ ID NO: 73916 - RNA, 1698 nt, Artificial Sequence; identical to SEQ ID NO: 64634
  derived and/or modified sequence opt1 from hemagglutinin__InfluenzaA__AJJ99652

SEQ ID NO: 73917 - RNA, 1698 nt, Artificial Sequence
  derived and/or modified sequence opt1 from hemagglutinin__InfluenzaA__AJJ99664
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggagaacagccacaacgggaagcucugccugcugaagggcaucgcgccccuccagcuggggaacugcuccaucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcgucuccagcuucgagcgguucgagaucuucccgaaggaguccagcuggcccaaccacacggugaccgggguguccgccagcugcucccacaacggcgagagcuccuucuaccgcaaccugcuguggcucaccgggaagaacggccuguaccccaaccugagcaaguccuacgccaacaacaaggagaaggagguccucgugcuguggggcgugcaccacccgcccaacaucggcgaccagaaggcccuguaccacaccgagaacgccuacgucagcguggugagcucccacuacagccggaaguucacgcccgagaucgcgaagcgccccaagguccgggaccaggagggccgcaucaacuacuacuggacccuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacagcucccugcccuuccagaacgugcacccggugaccaucggcgagugccccaaguacguccggagcgccaagcugcgcauggugaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucacgaacaaggucaacagcgugaucgagaagaugaacacccaguucaccgccguggggaaggaguucaacaagcuggagcggcgcauggagaaccucaacaagaaggucgacgacggcuucaucgacaucuggaccuacaacgcggagcugcuggugcuccuggagaacgagcggacgcuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 73918 - RNA, 1701 nt, Artificial Sequence
  derived and/or modified sequence opt1 from hemagglutinin__InfluenzaA__AJJ99675
augaaggccauccugcucgugcugcuguacaccuucgccaccgcgaaggccgacacgcucugcaucggcuaccacgccaacaacagcaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucaacuacgaggagcugcgggagcagcugagcuccgugagcuccuucgagcgcuucgagaucuuccccaagaccagcuccuggcccaaccacgacagcaacaagggggugaccgccgccugcccgcgggccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccacggccgaccagcagucccuguaccagaacgccgacgccuacgucuucgugggcaccagccgcuacuccaagaaguucaagcccgagaucgccauccggccgaaggugcgcgaccaggagggccggaugaacuacuacuggacccucgucgagcccggggacaagaucaccuucgaggcgacgggcaaccugcuggugccccgcuacgccuucgccauggagcggaacgccgggagcggcaucaucaucuccgacacccccgugcacgacugcaacacgaccugccagaccccgaagggcgccaucaacaccagccuccccuuccagaacauccaccccaucaccaucgggaagugccccaaguacgucaaguccaccaagcugcgccuggcgacgggccuccggaacgugccgagcauccagucccgcgggcuguucggcgccaucgccggguucaucgagggcggcuggaccgggaugguggacggcugguacggguaccaccaccagaacgagcagggcagcggguacgccgccgaccugaaguccacccagaacgcgaucgacaagaucaccgacaaggucaacagcgugaucgagaagaugaacacgcaguucaccgccgugggcaaggaguucaaccaccucgagaagcggaucgagaaccugaacaagaaggucgacgacggcuuccuggacaucuggaccuacaacgccgagcuccuggugcugcucgagaacgagcgcacccuggacuaccacgacuccaacgucaagaaccuguacgagaaggugcggaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcuggagagcacccggaucuaccagauccucgcgaucuacuccaccguggccagcucccuggugcuggucgugagccucggggccaucagcuucuggaugugcuccaacggcagccugcagugccgcaucugcaucuga

SEQ ID NO: 73919 - RNA, 1701 nt, Artificial Sequence
  derived and/or modified sequence opt1 from hemagglutinin__InfluenzaA__AJJ99686
augaccgccauccugcucgugcugcuguacaccuucgccacggcgaacgccgacacccucugcaucggcuaccacgccaacaacagcaccgacaccgucgacacggugcuggagaagaacgugaccgucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagacguccagcuccgacaacgggaccugcuaccccggcgacuucaucaacuacgaggagcugcgggagcagcugagcuccgugagcuccuucgagcgcuucgagaucuuccccaagaccagcuccuggcccaaccacgacagcaacaagggcgugaccgccgccugcccgcgggccggcgcgaaguccuucuacaagaaccucaucuggcuggucaagaaggggaacagcuaccccaagcuguccaagagcuacaucaacgacaagggcaaggaggugcucgugcugugggggauccaccaccccagcacgaccgccgaccagcagucccuguaccagaacgccgacgccuacgucuucgugggcaccagccgcuacuccaagaaguucaagcccgagaucgccauccggccgaaggugcgcgaccaggagggccggaugaacuacuacuggacccucgucgagcccggggacaagaucacguucgaggcgaccggcaaccugcuggugccccgcuacgccuucgccauggagcggaacgccgggagcggcaucaucaucuccgacacccccgugcacgacugcaacaccacgugccagaccccgaagggcgccaucaacaccagccuccccuuccagaacauccaccccaucaccaucgggaagugccccaaguacgucaaguccacgaagcugcgccuggcgaccggccuccggaacgugccgagcauccagucccgcgggcuguucggcgccaucgccggguucaucgagggcggcuggaccgggaugguggacggcugguacggguaccaccaccagaacgagcagggcagcggguacgccgccgaccugaaguccacccagaacgcgaucgacaagaucacgaacaaggucaacagcgugaucgagaagaugaacacccaguucaccgccgugggcaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgucaagaaccuguacgagaaggugcggaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcuggagagcacccggaucuaccagauccucgcgaucuacuccaccguggccagcucccuggugcuggucgugagccucggggccaucagcuucuggaugugcuccaacggcagccugcagugccgcaucugcaucuga

SEQ ID NO: 73920 - RNA, 1701 nt, Artificial Sequence
  derived and/or modified sequence opt1 from hemagglutinin__InfluenzaA__AJJ99697
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgugauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgucaaguccacgaagcugcggcucgccaccggccugcgcaacgugccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggagaagaucgacggcgucaagcucgagagcacccgcaucuaccagauccuggccaucuacuccaccguggccagcucccuggugcucgucgugagccugggggcgaucagcuucuggaugugcuccaacggcagccugcagugccggaucugcaucuga

SEQ ID NO: 73921 - RNA, 1701 nt, Artificial Sequence
  derived and/or modified sequence opt1 from hemagglutinin__InfluenzaA__AJJ99708
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgugauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgucaaguccacgaagcugcggcucgccaccggccugcgcaacgugccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggagaagaucgacggcgucaagcucgagagcacccgcaucuaccagauccuggccaucuacuccaccguggccagcucccuggugcucgucgugagccugggggcgaucagcuucuggaugugcuccaacggcagccugcagugccggaucugcaucuga

SEQ ID NO: 73922 - RNA, 1701 nt, Artificial Sequence
  derived and/or modified sequence opt1 from hemagglutinin__InfluenzaA__AJJ99719
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccacggccgaccagcagagccucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgagggggugaagcuggaguccacccgcaucuaccagauccucgccaucuacagcaccgucgcguccagccuggugcugguggucucccucggcgccaucagcuucuggaugugcagcaacggcucccugcagugccggaucugcaucuga

SEQ ID NO: 73923 - RNA, 1701 nt, Artificial Sequence
  derived and/or modified sequence opt1 from hemagglutinin__InfluenzaA__AJJ99730
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccacggccgaccagcagagccucuaccagaacgccgacaccuacguguucgugggcaccucccgguacagcaagaaguucaagcccgagaucgccauccgcccgaagguccgggaccaggaggggcgcaugaacuacuacuggacccugaucgagcccggcgacaagaucacguucgaggccaccgggaaccugguggugccccgguacgcguucgccauggagcgcaacgccggcuccggcaucaucaucagcgacacccccguccacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgugaucgagaagaugaacacccaguucaccgcggucggcaaggaguucaaccaccuggagaagcgcaucgagaaccugaacaagaagguggacgacggguuccuggacaucuggaccuacaacgccgagcuccugguccugcucgagaacgagcggacgcuggacuaccacgacagcaacgugaagaaccuguacgagaaggugcgcaaccagcucaagaacaacgccaaggagaucggcaacgggugcuucgaguuccaccacaagugcgacaacacgugcauggaguccgucaagaacggcaccuacgacuaccccaaguacagcgaggaggccaagcugaaccgggaggagaucgacggggugaagcuggaguccacccgcaucuaccagauccucgccaucuacagcaccguggcguccagccugguccugguggugucccucggcgccaucagcuucuggaugugcagcaacggcucccugcagugccggaucugcaucuga

SEQ ID NO: 73924 - RNA, 1701 nt, Artificial Sequence; identical to SEQ ID NO: 68050
  derived and/or modified sequence opt1 from hemagglutinin__InfluenzaA__AJJ99741

SEQ ID NO: 73925 - RNA, 1701 nt, Artificial Sequence; identical to SEQ ID NO: 64841
  derived and/or modified sequence opt1 from hemagglutinin__InfluenzaA__AJJ99752

SEQ ID NO: 73926 - RNA, 1701 nt, Artificial Sequence; identical to SEQ ID NO: 63677
  derived and/or modified sequence opt1 from hemagglutinin__InfluenzaA__AJJ99763

SEQ ID NO: 73927 - RNA, 1698 nt, Artificial Sequence
  derived and/or modified sequence opt1 from hemagglutinin__InfluenzaA__AJJ99775
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccacggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgcggccgaccagaaguccacccagaacgccaucaacggcaucaccaacaaggugaacagcgucaucgagaagaugaacacccaguucacggccgugggcaaggaguucaacaagcuggagcggcgcauggagaaccucaacaagaaggucgacgacggguucaucgacaucuggaccuacaacgccgagcugcuggugcuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccacgguggccagcagccuggugcuccuggucucccugggcgccaucagcuucuggaugugcuccaacgggagccuccagugccggaucugcaucuga

SEQ ID NO: 73928 - RNA, 1701 nt, Artificial Sequence
  derived and/or modified sequence opt1 from hemagglutinin__InfluenzaA__AJJ99786
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagaucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccgccguggccagcagccuggugcucgucgugucccugggggccaucagcuucuggaugugcuccaacggcagccugcagugccggaucugcaucuga

SEQ ID NO: 73929 - RNA, 1698 nt, Artificial Sequence
  derived and/or modified sequence opt1 from hemagglutinin__InfluenzaA__AJJ99798
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagcgccccaaccccgagaacgggaccugcuaccccggccacuucgccgacuacgaggagcugcgggagcagcucuccagcguguccagcuucgagcgcuucgagaucuucccgaaggaguccagcuggcccaaccacacggucaccgggguguccgccagcugcucccacaacggcgagaacagcuucuaccggaaccugcuguggcucaccgggaagaacggccuguaccccaaccuguccaagagcuacgccaacaacaaggagaaggaggugcucguccuguggggcgugcaccacccgcccaacaucgccaaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggcgacaccaucauguucgaggcgaacgggaaccugaucgccccgcgcuacgccuucgcccucagccggggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgcuccgccaagcugcggauggucaccggccuccgcaacauccccagcauccagucccgggggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgggagaagaucgacggggugaagcucgagagcaugggcgucuaccagauccuggccaucuacuccaccguggccagcagccuggugcuccuggucucccugggcgccaucagcuucuggaugugcuccaacgggagccuccagugccgcaucugcaucuga

SEQ ID NO: 73930 - RNA, 1698 nt, Artificial Sequence; identical to SEQ ID NO: 63496
  derived and/or modified sequence opt1 from hemagglutinin__InfluenzaA__AJJ99810

SEQ ID NO: 73931 - RNA, 1698 nt, Artificial Sequence
  derived and/or modified sequence opt1 from hemagglutinin__InfluenzaA__AJJ99822
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuucauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggccaucuacuccaccguggccagcagccuggugcuccuggucucccugggggccaucagcuucuggaugugcuccaacggcagccuccagugccggaucugcaucuga

SEQ ID NO: 73932 - RNA, 1701 nt, Artificial Sequence
  derived and/or modified sequence opt1 from hemagglutinin__InfluenzaA__AJJ99833
augaaggccauccugcucgugcugcuguacaccuucgccaccgcgaacgccgacacgcucugcaucggcuaccacgccaacaacagcaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucaacuacgaggagcugcgggagcagcugagcuccgugagcuccuucgagcgcuucgagaucuuccccaagaccagcuccuggcccaaccacgacagcaacaagggggugaccgccgccugcccgcgggccggcgcgaaguccuucuacaagaaccucaucuggcuggucaagaaggggaacagcuaccugaagcucuccaagagcuacaucaacgacaagggcaaggaggugcuggugcugugggggauccaccaccccagcaccacggccgaccagcagucccucuaccagaacgccgacgccuacgucuucgugggcaccagccgcuacuccaagaaguucaagcccgagaucgccauccggcccaaggugcgcgaccaggagggccggaugaacuacuacuggacccuggucgagccgggggacaagaucaccuucgaggcgacgggcaaccugcucgugccccgcuacgccuucgccauggagcggaacgccgggagcggcaucaucaucuccgacacccccgugcacgacugcaacacgaccugccagacccccaagggcgccaucaacaccagccugccguuccagaacauccaccccaucaccaucgggaagugccccaaguacgucaaguccaccaagcugcgccucgcgacgggccugcggaacgugcccagcauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgucaagaaccucuacgagaaggugcggaaccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgcgaggagaucgacggcgucaagcucgagagcacccggaucuaccagauccuggcgaucuacuccaccguggccagcucccuggugcucgucgugagccugggggccaucagcuucuggaugugcuccaacggcagccugcagugccgcaucugcaucuga

SEQ ID NO: 73933 - RNA, 1701 nt, Artificial Sequence; identical to SEQ ID NO: 67832
  derived and/or modified sequence opt1 from hemagglutinin__InfluenzaA__AJJ99844

SEQ ID NO: 73934 - RNA, 1701 nt, Artificial Sequence
  derived and/or modified sequence opt1 from hemagglutinin__InfluenzaA__AJJ99855
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacagcacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 73935 - RNA, 1701 nt, Artificial Sequence
  derived and/or modified sequence opt1 from hemagglutinin__InfluenzaA__AJJ99866
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 73936 - RNA, 1701 nt, Artificial Sequence
  derived and/or modified sequence opt1 from hemagglutinin__InfluenzaA__AJJ99877
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugcgcaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 73937 - RNA, 1701 nt, Artificial Sequence
  derived and/or modified sequence opt1 from hemagglutinin__InfluenzaA__AJJ99888
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcgacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaagaucgacgacggguuccucgacaucuggaccuacaacgccgagcugcugguccuccuggagaacgagcggacccuggacuaccacgacuccaacgugaagaaccucuacgagaaggugcgcagccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggcgaucuacagcaccguggccuccagccugguccucguggugagccugggcgccaucuccuucuggaugugcagcaacggcucccugcagugccggaucugcaucuga

SEQ ID NO: 73938 - RNA, 1701 nt, Artificial Sequence
  derived and/or modified sequence opt1 from hemagglutinin__InfluenzaA__AJJ99899
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcgggccggcgcgaaguccuucuacaagaaccugaucuggcucgugaagaaggggaacagcuaccccaaccuguccaagagcuacaucaacgacaagggcaaggaggugcugguccucugggggauccaccaccccagcaccacggccgaccagcagucccuguaccagaacgccgacgccuacguguucgugggcaccagccgcuacuccaagaaguucaagcccgagaucgccauccggccgaagguccgcgaccaggagggccggaugaacuacuacuggacccugcucgagcccggggacaagaucaccuucgaggcgacgggcaaccugcuggugccccgcuacgccuucgccauggagcggaacgccgggagcggcaucaucaucuccgacacccccgugcacgacugcaacacgaccugccagaccccgaagggcgccaucaacaccagccuccccuuccagaacauccaccccaucaccaucgggaagugccccaaguacgucaaguccaccaagcugcgccuggcgacgggccuccggaacgugccgagcauccagucccgcgggcuguucggcgccaucgccggguucaucgagggcggcuggaccgggaugguggacggcugguacggguaccaccaccagaacggccaggggagcggcuacgccgccgaccugaaguccacccagaacgcggucgacaagaucaccaacaaggugaacagcgugaucgagaagaugaacacgcaguucaccgccgucggcaaggaguucaaccaccucgagaagcggaucgagaaccugaacaagaagguggacgacggguuccuggacaucuggaccuacaacgccgagcuccugguccugcucgagaacgagcgcacccuggacuaccacgacuccaacgugaagaaccuguacgagaaggugcggaaccagcucaagaacaacgccaaggagaucggcaacgggugcuucgaguucuaccacaagugcgacaacacgugcauggagagcgucaagaacggcaccuacgacuaccccaaguacuccgaggaggccaagcugaaccgcgaggagaucgacggggugaagcuggagagcacccggaucuaccagauccucgcgaucuacuccaccguggccagcucccugguccugguggugagccucggcgccaucagcuucuggaugugcuccaacggcagccugcagugccgcaucugcaucuga

SEQ ID NO: 73939 - RNA, 1701 nt, Artificial Sequence
  derived and/or modified sequence opt1 from hemagglutinin__InfluenzaA__AJJ99910
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcgacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 73940 - RNA, 1701 nt, Artificial Sequence; identical to SEQ ID NO: 67832
  derived and/or modified sequence opt1 from hemagglutinin__InfluenzaA__AJJ99921

SEQ ID NO: 73941 - RNA, 1701 nt, Artificial Sequence
  derived and/or modified sequence opt1 from hemagglutinin__InfluenzaA__AJJ99932
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 73942 - RNA, 1701 nt, Artificial Sequence; identical to SEQ ID NO: 67462
  derived and/or modified sequence opt1 from hemagglutinin__InfluenzaA__AJJ99943

SEQ ID NO: 73943 - RNA, 1701 nt, Artificial Sequence
  derived and/or modified sequence opt1 from hemagglutinin__InfluenzaA__AJJ99954
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagaaguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucacgagcgacacccccgugcacgacugcaacacgaccugccagaccccgaagggcgccaucaacaccucccugcccuuccagaacauccaccccaucaccaucgggaacugccccaaguacgucaagagcaccaagcugcgccucgcgacgggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 73944 - RNA, 1701 nt, Artificial Sequence; identical to SEQ ID NO: 63919
  derived and/or modified sequence opt1 from hemagglutinin__InfluenzaA__AJJ99965

SEQ ID NO: 73945 - RNA, 1698 nt, Artificial Sequence
  derived and/or modified sequence opt1 from hemagglutinin__InfluenzaA__AJJ99989
augaaggugaagcugcucguccugcugugcaccuucaccgccacguacgccgacaccaucugcaucggcuaccacgcgaacaacagcaccgacaccguggacacggugcucgagcgcaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacggucaccgggguguccgccagcugcucccacaacggcgagagcuccuucuaccggaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagcaagaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagcggagcacccagaacgccaucaacggcaucacgaacaaggugaacuccgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 73946 - RNA, 1701 nt, Artificial Sequence
  derived and/or modified sequence opt1 from hemagglutinin__InfluenzaA__AJK00001
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcgggccggcgagaaguccuucuacaagaaccugaucuggcucgugaagaaggggaacagcuaccccaagcuguccaagagcuacaucaacgacaagggcaaggaggugcugguccucugggggauccaccaccccagcaccacggcggaccagcagucccuguaccagaacgccgacgccuacguguucgugggcaccagccgcuacuccaagaaguucaagcccgagaucgccauccggccgaagguccgcgaccaggagggccggaugaacuacuacuggacccugguggagcccggggacaagaucaccuucgaggccacgggcaaccuccuggugccccgcuacgcguucgccauggagcggaacgccgggagcggcaucaucaucuccgacacccccguccacgacugcaacacgaccugccagaccccgaagggcgccaucaacaccagccugcccuuccagaacauccaccccaucaccaucgggaagugccccaaguacgugaaguccaccaagcuccgccuggccacgggccugcggaacgugccgagcauccagucccgcggccucuucggggcgaucgccggguucaucgagggcggcuggaccgggauggucgacggcugguacggguaccaccaccagaacgagcagggcagcggguacgccgccgaccugaaguccacccagaacgccaucgacaagaucaccaacaaggugaacagcgugaucgagaagaugaacacgcaguucaccgcggucggcaaggaguucaaccaccuggagaagcggaucgagaaccucaacaagaagguggacgacggcuuccuggacaucuggaccuacaacgccgagcugcucguccugcuggagaacgagcgcacccucgacuaccacgacuccaacgugaagaaccuguacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgcgagaagaucgacggcgugaagcuggagagcacccggaucuaccagauccuggccaucuacuccaccguggcgagcucccucguccugguggugagccugggggccaucagcuucuggaugugcuccaacggcagccuccagugccgcaucugcaucuga

SEQ ID NO: 73947 - RNA, 1701 nt, Artificial Sequence
  derived and/or modified sequence opt1 from hemagglutinin__InfluenzaA__AJK00012
augaaggccauccuggugguccuccugugcaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacaccaccgugcacgacugcaacacgaccugccagacccccaagggggccaucaacaccucccugccguuccagaacauccaccccaucacgaucggcaagugccccaaguacgucaagagcaccaagcugcggcucgccaccgggcugcgcaacgugcccuccauccagagccggggccuguucggggcgaucgccggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcaaccagcugaagaacaacgccaaggagaucggcgacgggugcuucgaguucuaccacaagugcgacaacacgugcauggaguccgugaagaacggcaccuacgacuacccgaaguacagcgaggaggccaagcugaaccgggagaagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 73948 - RNA, 1701 nt, Artificial Sequence
  derived and/or modified sequence opt1 from hemagglutinin__InfluenzaA__AJK00023
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcgggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgcuacuccaagaaguucaagcccgagaucgccauccggccgaagguccgcgaccaggagggccggaugaacuacuacuggacccugguggagcccggggacaagaucaccuucgaggcgacgggcaaccuccuggugccccgcuacgccuucgccauggagcggaacgccgggagcggcaucaucaucuccgacacccccguccacgacugcaacacgaccugccagaccccgaagggcgccaucaacaccagccugcccuuccagaacauccaccccaucaccaucgggaagugccccaaguacgugaaguccaccaagcuccgccuggcgacgggccugcggaacgugccgagcauccagucccgcggccucuucggggccaucgccggguucaucgagggcggcuggaccgggauggucgacggcugguacggguaccaccaccagaacgagcagggcagcggguacgccgccgaccugaaguccacccagaacgcgaucgacaagaucaccaacaaggugaacagcgugaucgagaagaugaacacgcaguucaccgccgucggcaaggaguucaaccaccuggagaagcggaucgagaaccucaacaagaagguggacgacggcuuccuggacaucuggaccuacaacgccgagcugcucguccugcuggagaacgagcgcacccucgacuaccacgacuccaacgugaagaaccuguacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgcgaggagaucgacggcgugaagcuggagagcacccggaucuaccagauccuggcgaucuacuccaccguggccagcucccucguccugguggugagccugggggccaucagcuucuggaugugcuccaacggcagccuccagugccgcaucugcaucuga

SEQ ID NO: 73949 - RNA, 1701 nt, Artificial Sequence; identical to SEQ ID NO: 67832
  derived and/or modified sequence opt1 from hemagglutinin__InfluenzaA__AJK00034

SEQ ID NO: 73950 - RNA, 1701 nt, Artificial Sequence; identical to SEQ ID NO: 68050
  derived and/or modified sequence opt1 from hemagglutinin__InfluenzaA__AJK00045

SEQ ID NO: 73951 - RNA, 1701 nt, Artificial Sequence; identical to SEQ ID NO: 68050
  derived and/or modified sequence opt1 from hemagglutinin__InfluenzaA__AJK00056

SEQ ID NO: 73952 - RNA, 1701 nt, Artificial Sequence; identical to SEQ ID NO: 63919
  derived and/or modified sequence opt1 from hemagglutinin__InfluenzaA__AJK00067

SEQ ID NO: 73953 - RNA, 1698 nt, Artificial Sequence
  derived and/or modified sequence opt1 from hemagglutinin__InfluenzaA__AJK00079
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucacccggaagaacgggcuguaccccaaccuguccaagagcuacgccaacaacaaggagaaggaggugcucguccuguggggcgugcaccacccgcccaacaucgccgaccagaagacccuguaccacacggagaacgccuacguguccgucgugagcagccacuacucccgcaaguucacccccgagaucgccaagcggcccaaggugcgcgaccaggaggggcggaucaacuacuacuggacccuccuggagcccggcgacaccaucaucuucgaggcgaacggcaaccugaucgccccgcgcuacgccuucgcccucagccggggguucggcuccgggaucaucaacagcaacgcccccauggacaagugcgacgcgaagugccagacgccccagggcgccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggcuggaccggcaugguggacgggugguacggcuaccaccaccagaacgagcaggggagcggcuacgcggccgaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggggucuaccagauccuggccaucuacuccaccguggccagcagccuggugcuccuggucucccugggcgccaucagcuucuggaugugcuccaacggcagccuccagugccgcaucugcaucuga

SEQ ID NO: 73954 - RNA, 1698 nt, Artificial Sequence
  derived and/or modified sequence opt1 from hemagglutinin__InfluenzaA__AJK00091
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacgaucaccggggucuccgccagcugcucccacaacggcgagagcuccuucuaccgcaaccugcuguggcucaccgggaagaacggccuguaccccaaccugagcaaguccuacgccaacaacaaggagaaggaggugcucgugcuguggggcguccaccacccgcccaacaucggcgugcagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccguguccuucuggaugugcagcaacggcucccuccagugccgggugugcaucuga

SEQ ID NO: 73955 - RNA, 1698 nt, Artificial Sequence; identical to SEQ ID NO: 63496
  derived and/or modified sequence opt1 from hemagglutinin__InfluenzaA__AJK00103

SEQ ID NO: 73956 - RNA, 1701 nt, Artificial Sequence; identical to SEQ ID NO: 67928
  derived and/or modified sequence opt1 from hemagglutinin__InfluenzaA__AJK00114

SEQ ID NO: 73957 - RNA, 1701 nt, Artificial Sequence
  derived and/or modified sequence opt1 from hemagglutinin__InfluenzaA__AJK00125
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcgaggucgcgccccugcaccucggcaagugcaacaucgccggguggauccugggcaacccggagugcgagagccuguccaccgcgagcuccuggagcuacaucguggagaccuccagcuccgacaacgggacgugcuaccccggcgacuucaucgacuacgaggagcuccgggagcagcugagcuccgugagcuccuucgagcgcuucgagaucuuccccaagaccaacagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucguggggacgagccgguacuccaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcagcgggaucaucaucuccgacacgcccguguacgacugcaacacgaccugccagaccccgaagggcgccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggagaagaucgacggggugaagcucgaguccacccgcaucuaccagauccuggcgaucuacagcaccgucgccuccagccuggugcucguggucagccugggcgccaucuccuucuggaugugcagcaacgggucccugcagugccggaucugcaucuga

SEQ ID NO: 73958 - RNA, 1701 nt, Artificial Sequence; identical to SEQ ID NO: 63677
  derived and/or modified sequence opt1 from hemagglutinin__InfluenzaA__AJK00136

SEQ ID NO: 73959 - RNA, 1704 nt, Artificial Sequence
  derived and/or modified sequence opt1 from hemagglutinin__InfluenzaA__AJK00166
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcaagcccuccuucuuccgcaacgugguguggcugaucaagaagaacaacaccuaccccacgaucaagcggagcuacaacaacaccaaccaggaggaccuccugauccugugggggauccaccacuccaacgacgccgccgagcagaccaagcucuaccagaacccgaccacguacaucagcgucggcaccuccacccugaaccagcgccuggugcccaagaucgccacccggagcaaggugaacgggcaguccggccgcauggacuucuucuggacgauccucaagcccaacgacgcgaucaacuucgagagcaacgggaacuucaucgcccccgaguacgccuacaagaucgucaagaagggcgacagcgccaucaugaaguccgagguggaguacggcaacugcaacaccaagugccagaccccgaucggggccaucaacagcuccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggugaagcuggagagcaucggcaccuaccagauccuguccaucuacagcacggucgcguccagccucgcccuggccaucaugguggccgggcugucccucuggaugugcagcaacggcagccugcagugccgcaucugcaucuga

SEQ ID NO: 73960 - RNA, 1707 nt, Artificial Sequence
  derived and/or modified sequence opt1 from hemagglutinin__InfluenzaA__AJK00177
auggagaagaucgugcugcuccuggccgucgugagccuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgucaagccccucauccugcgggacugcuccguggccggguggcugcucggcaacccgaugugcgacgaguucaucaacgugcccgaguggagcuacaucgucgagaaggccaaccccgccaacgaccugugcuaccccgggaaccugaacgacuacgaggagcucaagcaccuccugucccgcaucaaccacuucgagaagauccagaucauccccaagagcuccuggagcgaccacgaggccucccugggcgugagcuccgcgugcccguaccagggcacccccagcuucuuccggaacguggucuggcugaucaagaagaacaacacguaccccaccaucaagcgcuccuacaacaacaccaaccaggaggaccugcucauccugugggggauccaccacagcaacgacgaggccgagcagaucaagcuguaccagaacccgaccacguacguguccgugggcaccagcacccucaaccagcggcugguccccaagaucgccacccgcuccaaggugaacgggcagagcggccggauggacuucuucuggacgauccugaagcccgacgacgccaucaacuucgaguccaacgggaacuucaucgcgcccgaguacgccuacaagaucgugaagaagggcgacagcgccaucaugaaguccgaggucgaguacggcaacugcaacaccaagugccagaccccgaucggggccaucaacagcagcaugcccuuccacaacauccacccccucaccaucggcgagugccccaaguacgugaaguccaacaagcuggugcuggccacggggcuccgcaacagcccgcugcgggagaagcgccggcgcaagcggggccuguucggcgcgaucgccggguucaucgagggcggguggcagggcauggucgacgggugguacggcuaccaccacuccaacgagcagggcagcggguacgccgccgacaaggaguccacccagaaggccaucgacggcgugaccaacaaggugaacagcaucaucgacaagaugaacacccaguucgaggcggucgggcgcgaguucaacaaccucgagcggcgcaucgagaaccugaacaagaagauggaggacggcuuccuggacguguggacguacaacgccgagcuccugguccugauggagaacgagcggacccucgacuuccacgacuccaacgugaagaaccuguacgacaaggugcgccugcagcuccgggacaacgccaaggagcuggggaacggcugcuucgaguucuaccacaagugcgacaacgagugcauggagagcguccgcaacggcaccuacgacuacccccaguacuccgaggaggcccggcugaagcgcgaggagaucagcggggugaagcucgaguccaucggcaucuaccagauccugagcaucuacuccaccguggccagcucccuggcgcucgccaucauggucgccgggcugagccuguggaugugcuccaacggcagccuccagugccgcaucugcaucuga

SEQ ID NO: 73961 - RNA, 1704 nt, Artificial Sequence
  derived and/or modified sequence opt1 from hemagglutinin__InfluenzaA__AJK00188
auggagaagaucgugcugcuccuggccgucgugagccuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgucaagccccucauccugcgggacugcuccguggccggguggcugcucggcaacccgaugugcgacgaguucaucaacgugcccgaguggagcuacaucgucgagaaggccaaccccgccaacgaccugugcuaccccgggaaccugaacgacuacgaggagcucaagcaccuccugucccgcaucaaccacuucgagaagauccagaucauccccaagagcuccuggagcgaccacgaggccucccugggcgugagcuccgcgugcccguaccagggcacccccagcuucuuccggaacguggucuggcugaucaagaagaacaacacguaccccaccaucaagcgcuccuacaacaacaccaaccaggaggaccugcucauccugugggggauccaccacagcaacgacgaggccgagcagaucaagcuguaccagaacccgaccacguacaucuccgugggcaccagcacccucaaccagcggcuggugcccaagaucgccacccgcuccaaggucaacgggcagagcggccggauggacuucuucuggacgauccugaagcccgacgacgccaucaacuucgaguccaacgggaacuucaucgcgcccgaguacgccuacaagaucgugaagaagggcgacagcgccaucaugaaguccgagguggaguacggcaacugcaacaccaagugccagaccccgaucggggccaucaacagcagcaugcccuuccacaacauccacccccucaccaucggcgagugccccaaguacgucaaguccaacaagcuggugcuggccacggggcuccgcaacagcccgcugcgggagaagcgccggaagcgcggccuguucggcgcgaucgccggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacccaguucgaggcgguggggcgggaguucaacaaccucgagcgccggaucgagaaccugaacaagaagauggaggacggcuuccuggacgucuggacguacaacgccgagcuccuggugcugauggagaacgagcgcacccucgacuuccacgacuccaacgucaagaaccuguacgacaaggugcggcugcagcuccgcgacaacgccaaggagcuggggaacggcugcuucgaguucuaccacaagugcgacaacgagugcauggagagcgugcggaacggcaccuacgacuacccccaguacuccgaggaggcccgccugaagcgggaggagaucagcggggucaagcucgaguccaucggcaccuaccagauccugagcaucuacuccacgguggccagcucccuggcgcucgccaucaugguggccgggcugagccuguggaugugcuccaacggcagccuccagugccgcaucugcaucuga

SEQ ID NO: 73962 - RNA, 1704 nt, Artificial Sequence
  derived and/or modified sequence opt1 from hemagglutinin__InfluenzaA__AJK00207
auggagaagaucgugcugcuccuggccaucgucagccuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgggacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccgcaucaaccacuucgagaagauccagaucauccccaagagcuccuggagcgaccacgaggccuccagcggcgucuccagcgcgugcccguaccagggcacccccuccuucuuccggaacgugguguggcugaucaagaagaacaacacguaccccaccaucaagcgcagcuacaacaacaccucccaggaggaccuccugguccugugggggauccaccacagcaacgacgccaccgagcagaugaagcucuaccagaacccgacgaccuacguguccgugggcaccagcacccugaaccagcggcugguccccaagaucgccacgcgcuccaaggugaacgggcagagcggccggauggacuucuucuggaccauccucaagagcaacgacgccaucaacuucgaguccaacgggaacuucaucgcgcccgaguacgccuacaagaucgugaagaagggcgacagcgccaucaugaaguccgaggucgaguacggcaacugcagcaccaagugccagacccccaucggggccaucaacuccagcaugccguuccacaacauccacccccugacgaucggcgagugccccaaguacgugaaguccaacaagcuggugcucgccaccgggcugcgcaacagcccccugcgggagcgccggcgcaagcggggccucuucggcgcgaucgccggguucaucgagggcggguggcagggcauggucgacgggugguacggcuaccaccacuccaacgagcagggcagcggguacgccgccgacaaggaguccacccagaaggccaucgacggcgugaccaacaaggugaacagcaucaucgacaagaugaacacgcaguucgaggcggucgggcgcgaguucaacaaccuggagcggcgcaucgagaaccugaacaagaagauggaggacggcuuccucgacguguggaccuacaacgccgagcugcugguccucauggagaacgagcggacccuggacuuccacgacuccaacgugaagaaccuguacgacaaggugcgccuccagcugcgggacaacaccaaggagcuggggaacggcugcuucgaguucuaccacaagugcgacaacgagugcauggagagcguccgcaacggcacguacgacuacccgcaguacuccgaggaggcccggcucaagcgcgaggagaucagcggggugaagcuggaguccaucggcaccuaccagauccugagcaucuacuccaccguggccagcagccucgcccuggcgaucauggucgccgggcugucccucuggaugugcagcaacggcucccugcagugccgcaucugcaucuga

SEQ ID NO: 73963 - RNA, 1704 nt, Artificial Sequence
  derived and/or modified sequence opt1 from hemagglutinin__InfluenzaA__AJK00218
auggagaagaucgugcuguuccucgccaucgucagccuggugcgcuccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgccaacgaccucugcuaccccgggaacuucaacgacuacgaggagcugaagcaccuccugucccgcaucaaccacuucgagaagauccggaucauccccaagagcuccuggccggaccacgaggccagcuccggcgucagcuccgcgugccccuaccagggcacccccagcuucuuccgcaacaucguguggcugaucaagaagaacaacacguacccgaccaucaagcgguccuacaacaacaccagccaggaggaccugcucgugcugugggggauccaccacuccagcgacgccaccgagcagaucaagcuguaccagaaccccacgaccuacgucuccgugggcaccagcacccucaaccagcgccuggugcccaagaucgccacgcgguccaaggucaacgggcagagcggccgcauggacuucuucuggaccauccucaagagcaacgacgccaucaacuucgaguccaacgggaacuucaucgcgcccgaguacgccuacaagaucgugaagaagggcgacagcgccaucaugaaguccgagguggaguacggcaacugcagcaccaagugccagaccccgaucggggccaucaacuccagcaugcccuuccacaacauccacccccugacgaucggcgagugccccaaguacgucaaguccaacaagcuggugcuggccaccgggcuccggaacagcccgcugcgcgagcggcgccggaagcgcggccuguucggcgcgaucgccggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggcgguggggcgggaguucaacaaccucgagcgccggaucgagaaccugaacaagaagauggaggacggcuuccuggacgucuggaccuacaacgccgagcuccuggugcugauggagaacgagcgcacccucgacuuccacgacuccaacgucaagaaccuguacgacaaggugcggcugcagcuccgcgacaacgccaaggagcuggggaacggcugcuucgaguucuaccacaagugcgacaacgagugcauggagagcgugcggaacggcaccuacgacuacccccaguacuccgaggaggcccgccugaagcgcgaggagaucagcggggucaagcucgaguccaucggcacguaccagauccugagcaucuacuccaccgccgcgagcagccuggcccucgccaucaugguggccgggcugucccuguggaugugcagcaacggcucccuccagugccggaucugcaucuga

SEQ ID NO: 73964 - RNA, 1704 nt, Artificial Sequence
  derived and/or modified sequence opt1 from hemagglutinin__InfluenzaA__AJK00239
auggagaagaucgugcugcuccuggccaucgucagccuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgggacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccgcaucaaccacuucgagaagauccagaucauccccaagagcuccuggagcgaccacgaggccuccagcggcgucuccagcgcgugcccguaccagggcacccccuccuucuuccggaacgugguguggcugaucaagaagaacaacacguaccccaccaucaagcgcagcuacaacaacaccucccaggaggaccuccugguccugugggggauccaccacagcaacgacgccaccgagcagaugaagcucuaccagaacccgacgaccuacguguccgugggcaccagcacccugaaccagcggcugguccccaagaucgccacgcgcuccaaggugaacgggcagagcggccggauggacuucuucuggaccauccucaagagcaacgacgccaucaacuucgaguccaacgggaacuucaucgcgcccgaguacgccuacaagaucgugaagaagggcgacagcgccaucaugaaguccgaggucgaguacggcaacugcagcaccaagugccagacccccaucggggccaucaacuccagcaugccguuccacaacauccacccccugacgaucggcgagugccccaaguacgugaaguccaacaagcuggugcucgccaccgggcugcgcaacagcccccugcgggagcgccggcgcaagcggggccucuucggcgcgaucgccggguucaucgagggcggguggcagggcauggucgacgggugguacggcuaccaccacuccaacgagcagggcagcggguacgccgccgacaaggaguccacccagaaggccaucgacggcgugaccaacaaggugaacagcaucaucgacaagaugaacacgcaguucgaggcggucgggcgcgaguucaacaaccuggagcggcgcaucgagaaccugaacaagaagauggaggacggcuuccucgacguguggaccuacaacgccgagcugcugguccucauggagaacgagcggacccuggacuuccacgacuccaacgugaagaaccuguacgacaaggugcgccuccagcugcgggacaacgccaaggagcuggggaacggcugcuucgaguucuaccacaagugcgacaacgagugcauggagagcguccgcaacggcaccuacgacuacccgcaguacuccgaggaggcccggcucaagcgcgaggagaucagcggggugaagcuggaguccaucggcacguaccagauccugagcaucuacuccaccguggccagcagccucgcgcuggccaucauggucgccgggcugucccucuggaugugcagcaacggcucccugcagugccgcaucugcaucuga

SEQ ID NO: 73965 - RNA, 1704 nt, Artificial Sequence
  derived and/or modified sequence opt1 from hemagglutinin__InfluenzaA__AJS18468
auggagaagaucgugcugcuccuggccgucgugagccuggugaaguccgaccagaucugcaucggcuaccacgccaacaacagcaccgagcaggucgacaccaucauggagaagaacgugacggugacccacgcgcaggacauccucgagaagacccacaacgggcgccugugcgaccugaacggcgucaagccccucauccugaaggacugcuccguggccggguggcugcucggcaacccgaugugcgacgaguucauccgggugcccgaguggagcuacaucgucgagcgcgccaaccccgccaacgaccugugcuaccccgggaaccugaacgacuacgaggagcucaagcaccuccugucccggaucaaccacuucgagaagacccugaucauccccaagagcuccuggccgaaccacgagacgagccugggcguguccgccgcgugccccuaccagggcgugcccagcuucuuccgcaacgucguguggcugaccaagaagaacgacgccuacccgaccaucaagauguccuacaacaacaccaaccgggaggaccuccugauccugugggggauccaccacagcaacaacgccgccgagcagacgaaccucuacaagaaccccaccaccuacguguccgucggcaccagcacgcugaaccagcgccuggugcccaagaucgcgacccggucccaggugaacgggcagcgcggccggauggacuucuucuggaccauccucaagcccaacgacgccauccacuucgagagcaacgggaacuucaucgccccggaguacgccuacaagaucgucaagaagggcgacuccaccaucaugaaguccgagauggaguacggccacugcaacacgaagugccagacccccaucggggccaucaacuccagcaugcccuuccacaacauccacccccugaccaucggcgagugcccgaaguacgucaagagcaacaagcuggugcucgcgaccgggcugcgcaacagcccccugcgggagcgccggcgcaagcggggccucuucggcgccaucgccggguucaucgagggcggguggcagggcaugguggacgggugguacggcuaccaccacagcaacgagcagggcuccggguacgccgccgaccgcgagagcacgcagaaggcgaucgacggcgugaccaacaaggugaacuccaucaucgacaagaugaacacccaguucgaggccgucgggcgggaguucaacaaccuggagcgccggaucgagaaccugaacaagaagauggaggacggcuuccucgacguguggaccuacaacgccgagcugcugguccucauggagaacgagcgcacgcuggacuuccacgacagcaacgugaagaaccuguacgacaaggugcggcuccagcugcgcgacaacgccaaggagcuggggaacggcugcuucgaguucuaccacaagugcgacaacgagugcauggaguccguccgcaacggcaccuacgacuacccccaguacagcgaggaggcccggcucaagcgcgaggagaucuccggggugaagcuggagagcaucggcaccuaccagauccuguccaucuacagcaccguggcguccagccucacgcuggccaucaucgucgccgggcugucccucuggaugugcagcaacggcucccugcagugccggaucugcaucuga

SEQ ID NO: 73966 - RNA, 1704 nt, Artificial Sequence
  derived and/or modified sequence opt1 from hemagglutinin__InfluenzaA__AJS18479
auggagaagaucgugcugcuccuggccgucgugagccuggugaaguccgaccagaucugcaucggcuaccacgccaacaacagcaccgagcaggucgacaccaucauggagaagaacgugacggugacccacgcgcaggacauccucgagaagacccacaacgggcgccugugcgaccugaacggcgucaagccccucauccugaaggacugcuccguggccggguggcugcucggcaacccgaugugcgacgaguucauccgggugcccgaguggagcuacaucgucgagcgcgccaaccccgccaacgaccugugcuaccccgggaaccugaacgacuacgaggagcucaagcaccuccugucccggaucaaccacuucgagaagacccugaucauccccaagagcuccuggccgaaccacgagacgagccugggcguguccgccgcgugccccuaccagggcaugcccagcuucuuccgcaacguggucuggcugaccaagaagaacgacaccuacccgaccaucaagauguccuacaacaacacgaaccgggaggaccuccugauccugugggggauccaccacagcaacaacgccgccgagcagaccaaccucuacaagaaccccaccaccuacguguccgugggcacggccacccugaaccagcgccugguccccaagaucgcgacccggagccaggugaacgggcagcgcggccggauggacuucuucuggaccauccucaagcccaacgacgccauccacuucgaguccaacgggaacuucaucgccccggaguacgccuacaagaucgugaagaagggcgacagcacgaucaugaaguccgagauggaguacggccacugcaacaccaagugccagacccccaucggggccaucaacagcuccaugcccuuccacaacauccacccccugaccaucggcgagugcccgaaguacgucaagagcaacaagcuggugcucgcgacggggcugcgcaacagcccccugcgggagcgccggcgcaagcggggccucuucggcgccaucgccggguucaucgagggcggguggcagggcaugguggacgggugguacggcuaccaccacuccaacgagcagggcagcggguacgccgccgaccgcgaguccacccagaaggcgaucgacggcgucaccaacaaggugaacagcaucaucgacaagaugaacacccaguucgaggccguggggcgggaguucaacaaccuggagcgccggaucgagaaccugaacaagaagauggaggacggcuuccucgacgucuggacguacaacgccgagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcgcaacggcaccuacgacuacccccaguacuccgaggaggcccggcucaagcgcgaggagaucagcggggucaagcuggaguccaucggcaccuaccagauccugagcaucuacuccacgguggcgagcucccucgcccuggccaucaucguggccgggcugagccucuggaugugcuccaacggcagccugcagugccggaucugcaucuga

SEQ ID NO: 73967 - RNA, 1704 nt, Artificial Sequence
  derived and/or modified sequence opt1 from hemagglutinin__InfluenzaA__AJY79339
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaaccugaacgacuacgaggagcucaagcaccuccugucccggaucaaccacuucgagaagauccagaucaucccgaaggacagcugguccgaccacgaggccagcggcgucuccagcgccugccccuaccagggccgcuccagcuucuuccggaacgugguguggcugaccaagaagaacgacgcguaccccacgaucaagaaguccuacaacaacaccaaccaggaggaccugcugguccucugggggauccaccaccccaacgacgccgccgagcagacccgccuguaccagaacccgaccacguacaucagcgugggcaccuccacccugaaccagcggcucgugcccaagaucgccacccgcagcaaggucaacgggcaguccggccggauggaguucuucuggacgauccucaagagcaacgacgcgaucaacuucgaguccaacgggaacuucaucgcccccgagaacgccuacaagaucgugaagaagggcgacagcaccaucaugaaguccgagcuggaguacuccaacugcaacaccaagugccagacccccaucggcgccaucaacagcuccaugccguuccacaacauccacccccugacgaucggggagugccccaaguacgucaagagcaaccgccuggugcuggccaccggccuccggaacagcccccagggggagaagcgccggaagaagcgcggccuguucggcgcgaucgccggguucaucgagggcggguggcagggcaugguggacgggugguacggcuaccaccacagcaacgagcagggcuccggguacgccgccgacaaggagagcacccagcgggccaucgacggcgugaccaacaaggucaacuccaucaucgacaagaugaacacgcaguucgaggcgguggggcgcgaguucaacaaccuggagcggcgcaucgagaaccucaacaagaagauggaggacggcuuccuggacguguggaccuacaacgccgagcugcucguccugauggagaacgagcggacccuggacuuccacgacagcaacgugaagaaccucuacgacaagguccgccugcagcugcgggacaacgccaaggagcucgggaacggcugcuucgaguucuaccaccgcugcgacaacgagugcauggaguccgugcggaacggcaccuacgacuacccgcaguacagcgaggaggcccgccugaagcgcgaggagaucuccggggugaagcuggagagcaucggcacguaccagauccucuccaucuacagcaccgucgccuccagccuggcgcuggccaucaugguggccgggcucucccuguggaugugcagcaacggcagccugcagugccggaucugcaucuga

SEQ ID NO: 73968 - RNA, 1704 nt, Artificial Sequence
  derived and/or modified sequence opt1 from hemagglutinin__InfluenzaA__AJY79341
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaaggacagcugguccgaccacgagaccagcggcgucuccagcgccugccccuaccagggccgcuccagcuucuuccggaacgugguguggcugacgaagaagaacgacgccuaccccaccaucaagaaguccuacaacaacaccaaccaggaggaccuccugguccugugggggauccaccaccccaacgacgcggccgagcagacccgccucuaccagaacccgacgaccuacaucagcgugggcaccuccacccugaaccagcggcuggugcccaagaucgccacgcgcagcaaggucaacgggcagaacggccggauggaguucuucuggaccauccucaaguccaacgacgccaucaacuucgagagcaacgggaacuucaucgcgcccgagaacgccuacaagaucgugaagaagggcgacuccaccaucaugcgcagcgagcuggaguacagcaacugcaacaccaagugccagacgcccaucggcgccaucaacuccagcaugccguuccacaacauccacccccugaccaucggggagugccccaaguacgugaaguccaaccggcucguccuggccaccggccugcgcaacagcccccagggggagaagcggcgcaagaagcggggccucuucggcgccaucgcgggguucaucgagggcggguggcagggcaugguggacgggugguacggcuaccaccacuccaacgagcagggcagcggguacgccgccgacaaggaguccacccagcgcgccaucgacggcgugacgaacaaggucaacagcaucaucgacaagaugaacacccaguucgaggccguggggcgggaguucaacaaccuggagcgccggaucgagaaccugaacaagaagauggaggacggcuuccucgacguguggaccuacaacgcggagcugcugguccucauggagaacgagcgcacccuggacuuccacgacuccaacgugaagaaccuguacgacaagguccggcuccagcugcgcgacaacgccaaggagcuggggaacggcugcuucgaguucuaccaccggugcgacaacgagugcauggagagcgugcgcaacggcacguacgacuacccgcaguacuccgaggaggcccgccucaagcgggaggagaucagcggggugaagcuggaguccaucggcaccuaccagauccugagcaucuacuccaccgucgccagcucccucgcccuggcgaucaugguggccgggcugagccucuggaugugcuccaacggcagccugcagugccgcaucugcaucuga

SEQ ID NO: 73969 - RNA, 1704 nt, Artificial Sequence
  derived and/or modified sequence opt1 from hemagglutinin__InfluenzaA__AJY79342
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaaggacagcugguccgaccacgaggccagcggcgucuccagcgccugccccuaccagggccgcuccagcuucuuccggaacgugguguggcugaccaagaagaacgacgcguaccccacgaucaagaaguccuacaacaacaccaaccaggaggaccuccugguccugugggggauccaccaccccaacgacgccgccgagcagacccgccucuaccagaacccgaccacguacaucagcgugggcaccuccacccugaaccagcggcuggugcccaagaucgccacccgcagcaaggucaacgggcaguccggccggauggaguucuucuggacgauccucaagagcaacgacgcgaucaacuucgaguccaacgggaacuucaucgcccccgagaacgccuacaagaucgugaagaagggcgacagcaccaucaugaaguccgagcuggaguacuccaacugcaacaccaagugccagacccccaucggcgccaucaacagcuccaugccguuccacaacauccacccccugacgaucggggagugccccaaguacgucaagagcaaccgccucgugcuggccaccggccugcggaacagcccccagggggagaagcgccggaagaagcgcggccucuucggcgcgaucgccggguucaucgagggcggguggcagggcaugguggacgggugguacggcuaccaccacagcaacgagcagggcuccggguacgccgccgacaaggagagcacccagcgggccaucgacggcgugaccaacaaggucaacuccaucaucgacaagaugaacacgcaguucgaggcgguggggcgcgaguucaacaaccuggagcggcgcaucgagaaccugaacaagaagauggaggacggcuuccucgacguguggaccuacaacgccgagcugcugguccucauggagaacgagcggacccuggacuuccacgacagcaacgugaagaaccuguacgacaagguccgccuccagcugcgggacaacgccaaggagcuggggaacggcugcuucgaguucuaccaccgcugcgacaacgagugcauggaguccgugcggaacggcaccuacgacuacccgcaguacagcgaggaggcccgccucaagcgcgaggagaucuccggggugaagcuggagagcaucggcacguaccagauccuguccaucuacagcaccgucgccuccagccucgcgcuggccaucaugguggccgggcugucccucuggaugugcagcaacggcagccugcagugccggaucugcaucuga

SEQ ID NO: 73970 - RNA, 1704 nt, Artificial Sequence
  derived and/or modified sequence opt1 from hemagglutinin__InfluenzaA__AJY79343
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaaggacagcugguccgaccacgaggccagcggcgucuccagcgccugccccuaccagggccgcuccagcuucuuccggaacgugguguggcugaccaagaagaacgacgcguaccccacgaucaagaaguccuacaacaacaccaaccaggaggaccuccugguccugugggggauccaccaccccaacgacgccgccgagcagacccgccucuaccagaacccgaccacguacaucagcgugggcaccuccacccugaaccagcggcuggugcccaagaucgccacccgcagcaaggucaacgggcaguccggccggauggaguucuucuggacgauccucaagagcaacgacgcgaucaacuucgaguccaacgggaacuucaucgcccccgagaacgccuacaagaucgugaagaagggcgacagcaccaucaugaaguccgagcuggaguacuccaacugcaacaccaagugccagacccccaucggcgccaucaacagcuccaugccguuccacaacauccacccccugacgaucggggagugccccaaguacgucaagagcaaccgccucgugcuggccaccggccugcggaacagcccccagggggagaagcgccggaagaagcgcggccucuucggcgcgaucgccggguucaucgagggcggguggcagggcaugguggacgggugguacggcuaccaccacagcaacgagcagggcuccggguacgccgccgacaaggagagcacccagcgggccaucgacggcgugaccaacaaggucaacuccaucaucgacaagaugaacacgcaguucgaggcgguggggcgcgaguucaacaaccuggagcggcgcaucgagaaccugaacaagaagauggaggacggcuuccucgacguguggaccuacaacgccgagcugcugguccucauggagaacgagcggacccuggacuuccacgacagcaacgugaagaaccuguacgacaagguccgccuccagcugcgggacaacgccaaggagcuggggaacggcugcuucgaguucuaccaccgcugcgacgacgagugcauggaguccgugcggaacggcaccuacgacuacccgcaguacagcgaggaggcccgccucaagcgcgaggagaucuccggggugaagcuggagagcaucggcacguaccagauccuguccaucuacagcaccgucgccuccagccucgcgcuggccaucaugguggccgggcugucccucuggaugugcagcaacggcagccugcagugccggaucugcaucuga

SEQ ID NO: 73971 - RNA, 1704 nt, Artificial Sequence
  derived and/or modified sequence opt1 from hemagglutinin__InfluenzaA__AJY79345
auggagaagaucgugcugcuccuggccaucgucagcaucgugaaguccgaccagaucugcaucggcuaccacgccaacaacagcaccgagcaggucgacaccaucauggagaagaacgugacggugacccgcgcgcaggacauccuggagaagacccacaacgggaagcucugcaaccuggacggcgugaagccccugauccuccgggacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccgcaucaaccacuucgagaagauccagaucaucccgaaggacagcugguccgaccacgaggccagcggcgucuccagcgccugccccuaccagggccgguccagcuucuuccgcaacgugguguggcugaccaagaagaacgacgcguaccccacgaucaagaaguccuacaacaacaccaaccaggaggaccuccugguccugugggggauccaccaccccaacgacgccgccgagcagacccggcucuaccagaacccgaccacguacaucagcgugggcaccuccacccugaaccagcgccuggugcccaagaucgccacccggagcaaggucaacgggcaguccggccgcauggaguucuucuggacgauccucaagagcaacgacgcgaucaacuucgaguccaacgggaacuucaucgcccccgagaacgccuacaagaucgugaagaagggcgacagcaccaucaugaaguccgagcuggaguacuccaacugcaacaccaagugccagacccccaucggcgccaucaacagcuccaugccguuccacaacauccacccccugacgaucggggagugccccaaguacgucaagagcaaccggcucgugcuggccaccggccugcgcaacagcccccagggggagaagcggcgcaagaagcggggccucuucggcgcgaucgccggguucaucgagggcggguggcagggcaugguggacgggugguacggcuaccaccacagcaacgagcagggcuccggguacgccgccgacaaggagagcacccagcgcgccaucgacggcgugaccaacaaggucaacuccaucaucgacaagaugaacacgcaguucgaggcgguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccaccggugcgacaacgagugcauggaguccgugcgcaacggcaccuacgacuacccgcaguacagcgaggaggcccgccucaagcgggaggagaucuccggggugaagcuggagagcaucggcacguaccagauccuguccaucuacagcaccgucgccuccagccucgcgcuggccaucaugguggccgggcugucccucuggaugugcagcaacggcagccugcagugccgcaucugcaucuga

SEQ ID NO: 73972 - RNA, 1701 nt, Artificial Sequence; identical to SEQ ID NO: 73449
  derived and/or modified sequence opt1 from hemagglutinin__InfluenzaA__AKA54643

SEQ ID NO: 73973 - RNA, 1701 nt, Artificial Sequence
  derived and/or modified sequence opt1 from hemagglutinin__InfluenzaA__AKA54650
augaagaccaucaucgcccugagcuacauccucugccugguguucacccagaagauccccggcaacgacaacuccacggccacccugugccucgggcaccacgcggucccgaacggcaccaucgugaagaccaucacgaacgaccgcaucgaggugaccaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgccucccugcgcagccuggucgcguccagcggcacgcucgaguucaacaacgaguccuucaacuggaccggggugacccagaacggcaccagcuccgccugcauccggcgcagcuccagcuccuucuucagccggcugaacuggcugacgcaccucaacuacaaguaccccgcccugaacgugaccaugcccaacaacgagcaguucgacaagcuguacaucuggggcguccaccaccccgggaccgacaaggaccagaucuuccucuacgcccaguccagcgggcgcaucaccgugagcacgaagcggucccagcaggcggugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggccaccggcaugcggaacguccccgagaagcagacccgcgggaucuucggcgcgaucgccggguucaucgagaacggcugggagggcaugguggacgggugguacggcuuccggcaccagaacuccgaggggcgcggccaggccgccgaccucaagagcacgcaggccgcgaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggagcauccggaacggcaccuacgaccacaacguguaccgcgacgaggcgcugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 73974 - RNA, 1701 nt, Artificial Sequence
  derived and/or modified sequence opt1 from hemagglutinin__InfluenzaA__AKA54651
augaagaccaucaucgccuucagcugcauccugugccagaucuccgcccagaagcuccccggcagcgacaacuccauggcgacccugugccuggggcaccacgccgugccgaacggcacgcucgucaagaccaucaccgacgaccagaucgaggugaccaacgccacggagcuggugcagagcaccuccaagggggagaucugcagcagcccccaccagauccuggacggcaagaacugcacccucaucgacgcccugcugggggacccccacugcgacgacuuccagaacaagaagugggaccucuucgucgagcgcagcaccgccuacuccaacugcuaccccuacuacgugccggacuacgcgagccugcggucccugguggccagcuccggcacgcucgaguucacccaggagagcuucaacuggaccggcgucgcccaggacggggccuccuacagcugccgccgggaguccgagaacagcuucuucucccgccugaacuggcuguacagccucaacuacaaguaccccgcgcugaacgugaccaugcccaacaacgacaaguucgacaagcuguacaucuggggcgugcaccaccccgggacggacaaggaccagaccagccucuacauccaggccuccggccgggucaccgugagcaccaaguggucccagcagacggugaucccgaacaucgggagccgccccuggauccggggcgucuccagcaucaucuccaucuacuggaccaucgugaagcccggcgacauccugcugaucaacagcaccgggaaccucaucgcgccccgcggcuacuucaagauccaguccgggaaguccuccaucaugcggagcgacgcccacaucggcaacugcaacuccgagugcaucaccccgaacggcagcauccccaacgacaagcccuuccagaacgugaaccgcaucacguacggggccugcccccgguacgucaagcagaacacccugaagcuggccaccggcaugcgcaacgugccggagaagcagacccgggggaucuucggcgccaucgccggguucaucgagaacggcugggagggcaugguggacgggugguacggcuuccgccaccagaacuccgaggggacgggccaggccgccgaccucaagagcacccaggcggccaucaaccagaucaccgggaagcugaaccgggucaucaagaagaccaacgagaaguuccaccagaucgagaaggaguucuccgagguggagggccgcauccaggaccuggagcgguacguggaggacacgaagaucgaccucuggagcuacaacgccgagcugcuggucgcccucgagaaccagcacaccaucgaccugaccgacuccgagaugaacaagcuguucgagcgcacccggaagcagcuccgcgagaacgccgaggacaugggcaacgggugcuucaagaucuaccacaagugcgacaacgcgugcaucggcagcauccggaacgggacguacgaccacgacguguaccgcgacgaggccgugaacaaccgcuuccagaucaagggcguccagcugaagcugggguacaaggacuggauccucuggaucagcuucgccaucuccugcuuccugcugugcgccgugcuccugggcuucaucaugugggccugccagaagggcaacauccggugcaacaucugcaucuga

SEQ ID NO: 73975 - RNA, 1701 nt, Artificial Sequence
  derived and/or modified sequence opt1 from hemagglutinin__InfluenzaA__AKA59351
augaaggccauccuggugauccuccuguacaccuucgccgcggccaacgccgacaccaucugcaucggcuaccacgccaacaacagcacggacaccgucgacaccgugcuggagaagaacgugaccgucacgcacuccguggaccuccuggaggacaagcacaacgggcgccugugcaagcuccggggcguggcgccccugcaccuggggaagugcaacaucgccggcuggauccucgggaacccggagugcgagagccuguccaccgccagcuccuggagcuacaucgucgagaccuccagcuccgacaacgggaccugcuaccccggcgacuucaucgacuacgaggagcugcgcgagcagcucagcuccgugagcuccuucgagcgguucgagaucuuccccaagacgagcuccuggcccaaccacgagagcaacaagggggugaccgccgccugcccgcaggcgggcgccaaguccuucuacaagaaccugaucuggcuggucaagaaggagaacagcuaccccaagcucuccaagagcuacaucaacgacaaggggaaggaggugcuggugcuguggggcauccaccaccccagcaccuccgccgaccagcagagccucuaccagaacgccgacgccuacgucuucguggggaccucccgcuacagcaagaaguucaagcccgagaucgcgauccggccgaaggugcgcgaccaggagggccggaugaacuacuacuggacgcuggucgagcccggcgacaagaucaccuucgaggccaccgggaaccugguggugccccgcuacgccuucgccauggagcggaacgccggcuccgggaucaucaucagcgacacccccguccacgacugcaacacgaccugccagaccccgaagggcgcgaucaacaccucccuccccuuccagaacauccaccccaucacgaucggcaagugccccaaguacgucaagagcaccaagcugcgccuggccaccgggcuccggaacgugccguccauccagagccgcggccuguucggggccaucgccggcuucaucgagggcggcuggaccggcaugguggacgggugguacggcuaccaccaccagaacgagcagggguccggcuacgccgcggaccucaagagcacgcagaacgccaucgacgagaucaccaacaaggugaacuccgugaucgagaagaugaacacccaguucaccgccgucgggaaggaguucaaccaccuggagaagcggaucgagaaccugaacaagaagguggacgacggcuuccuggacaucuggacguacaacgccgagcuccugguccugcucgagaacgagcgcacccuggacuaccacgacagcaacgugaagaaccuguacgagaaggugcggucccagcucaagaacaacgccaaggagaucggcaacgggugcuucgaguucuaccacaagugcgacaacacgugcauggagagcgucaagaacggcaccuacgacuaccccaaguacuccgaggaggcgaagcugaaccgcgaggagaucgacggggugaagcuggagagcacccggaucuaccagauccucgccaucuacuccaccguggccagcagccugguccugguggugucccucggcgccaucagcuucuggaugugcuccaacgggagccugcagugccgcaucugcaucuga

SEQ ID NO: 73976 - RNA, 1701 nt, Artificial Sequence
  derived and/or modified sequence opt1 from hemagglutinin__InfluenzaA__AKA59353
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucggggagugcaacaucgccggcuggauccuggggaacccggagugcgagagccuguccaccgccagcuccuggagcuacaucguggagacccccuccagcaacaacggcacgugcuaccccggcgacuucaucgacuacgaggagcuccgggagcagcuguccagcguguccagcuucgagcgcuucgagaucuuccccaacaccuccagcuggccgaaccacgacuccagcaagggggucaccgccgccugcccccacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagaagcuguaccagaacgaggacgccuacguguucgugggcacgagccgguacuccaagaaguucaagccggagaucgccauccgccccaagguccgggaccaggagggccgcaugaacuacuacuggacccugguggagcccggggacaagaucaccuucgaggccaccggcaacaucguggucccccgguacgcguucgccauggagcgcaacgccgggagcggcaucaucaucuccgacacgccggugcacaacugcaacacgaccugccagacccccaagggcgccaucaacaccagccuccccuuccagaacgugcaccccaucaccaucgggaagugcccgaaguacgucaaguccaccaagcugcggcuggccaccggccuccgcaacgugcccagcauccagucccgggggcuguucggcgcgaucgccggguucaucgagggcggcuggacggggaugguggacggcugguacggguaccaccaccagaacgagcagggcagcggguucgccgccgaccugaaguccacccagaacgccaucgacggcaucaccaacaaggucaacagcgugaucgagaagaugaacacccaguucacggcggucggcaaggaguucaaccaccucgagaagcgcaucgagaaccugaaccggaagaucgacgacggguuccuggacaucuggaccuacaacgccgagcuccugauccugcucgagaacgagcgcacccuggacuaccacgacuccaacgugcggaaccuguacgagaaggugcgcagccagcucaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcuggaguccacccgcaucuaccagauccucgccaucuacagcaccguggcguccagccugguccugaucgugagccucggcgccaucuccuucuggaugugcagcaacggcucccugcagugccggaucugcaucuga

SEQ ID NO: 73977 - RNA, 1701 nt, Artificial Sequence
  derived and/or modified sequence opt1 from hemagglutinin__InfluenzaA__AKA59355
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgcgguccuucuacaagaaccugaucuggcucgugaagaaggggaacagcuaccccaagcugaaccaguccuacaucaacgacaagggcaaggaggugcugguccucugggggauccaccacccgcccaccagcgccgaccagcagagccuguaccagaacgccgacgccuacguguucgugggcacgucccgcuacagcaagaaguucaagcccgagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgccggugcacgacugcaacacgaccugccagacccccaagggcgccaucaacaccucccugcccuuccagaacauccaccccaucaccaucgggaagugcccgaaguacgucaagagcaccaagcugcgccucgcgaccggccugcggaacgugcccuccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaaccuggucaucgagaagaugaacacccaguucacggccgugggcaaggaguucucccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagauccggucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgcgaggagaucgacggcgugaagcuggagagcacccggguguaccagauccuggcgaucuacuccaccgucgccagcucccucgugcugguggucagccugggggccaucagcuucuggaugugcuccaacggcagccuccagugccgcaucugcaucuga

SEQ ID NO: 73978 - RNA, 1701 nt, Artificial Sequence
  derived and/or modified sequence opt1 from hemagglutinin__InfluenzaA__AKE37137
augaaggcccgccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaccuccuacaucaacgacaagggcaaggaggugcugguccucugggggauccaccaccccagcacgagcgccgaccagcagucccuguaccagaacgccgacgccuacgccuucgugggcaccagccgcuacuccaagaaguucaagccggagaucgcgauccggcccaaggugcgcgaccgggagggccgcaugaacuacuacuggacccuggucgagcccggggacaagaucaccuucgaggccacgggcaaccucguggugccccgguacgccuucgccauggagcgcaacgccgggagcggcaucaucaucuccgacaccagcguccacgacugcaacacgaccugccagaccccgaagggcgcgaucaacaccucccugcccuuccagaacgugcaccccaucaccaucgggaagugccccaaguacgucaagagcaccaagcugcggcucgccacgggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacccagaacgccuucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 73979 - RNA, 1701 nt, Artificial Sequence
  derived and/or modified sequence opt1 from hemagglutinin__InfluenzaA__AKS48035
auggagaagauggugcugcuccuggccgucgugagccuggugaaguccgaccagaucugcaucggcuaccacgccaacaacagcaccgagcaggucgacaccaucauggagaagaacgugacggugacccacgcgcaggacauccucgagaagacccacaacgggcgccugugcgaccugaacggcgucaagccccucauccugaaggacugcuccguggccggguggcugcucggcaacccgaugugcgacgaguucauccgggugcccgaguggagcuacaucgucgagcgcgccaaccccgccaacgaccugugcuaccccgggaaccugaacgacuacgaggagcucaagcaccuccugucccggaucaaccacuucgagaagacccugaucauccccaagagcuccuggccgaaccacacgagcuccggcgugagcgccgcgugccccuaccagggcaugcccuccuucuuccgcaacguggucuggcugaccaagaagaacgacgccuacccgaccaucaagaugagcuacaacaacaccuaccgggaggaccugcucauccugugggggauccaccacuccaacaacgccgccgagcagacgaaccuguacaagaaccccaccaccuacgugagcgugggcaccuccacgcucaaccagcgccuggagcccaagaucgcgacccggagccaggucaacgggcagcgcggccggauggacuucuucuggaccauccugaagcccaacgacgccauccacuucgaguccaacgggaacuucaucgccccggaguacgccuacaagaucgugaagaagggcgacagcaccaucaugaaguccgagauggaguacggccacugcaacacgaagugccagacccccaucggggccaucaacagcagcaugcccuuccacaacauccacccccucaccaucggcgagugcccgaaguacgugaaguccaacaagcugguccuggcgaccgggcuccgcaacagcccccugcgggagcgccggcgcaagcggggccuguucggcgccaucgccggguucaucgagggcggguggcagggcaugguggacgggugguacggcuaccaccacuccaacgagcagggcagcggguacgccgccgaccgcgaguccacgcagaaggcgaucgacggcgugaccaacaaggucaacagcaucaucgacaagaugaacacccaguucgaggccguggggcgggaguucaacaaccucgagcgccggaucgagaaccugaacaagaagauggaggacggcuuccuggacguguggaccuacaacgccgagcuccugguccugauggagaacgagcgcacgcucgacuuccacgacuccaacgugaagaaccuguacgacaagguccggcugcagcuccgcgacaacgccaaggagcuggggaacggcugcuucgaguucuaccacaagugcgacaacgagugcauggagagcgugcgcaacggcaccuacgacuacccccaguacuccgaggaggcccggcugaagcgcgaggagaucagcggggugaagcucgaguccaucggcaccuaccagauccugagcaucuacuccaccgucgcgagcucccuggcccucgccaucaucguggccgggcugagccuguggaugugcuccaacggcagccuccagugccggaucugcaucuga

SEQ ID NO: 73980 - RNA, 1701 nt, Artificial Sequence
  derived and/or modified sequence opt1 from hemagglutinin__InfluenzaA__ALA08472
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacgucuggggcgugcaccaccccgggaccgacaaggaccagaucuuccucuacgcgcaguccagcgggcgcaucaccgugagcacgaagcggucccagcaggccgucaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 73981 - RNA, 1701 nt, Artificial Sequence; identical to SEQ ID NO: 73449
  derived and/or modified sequence opt1 from hemagglutinin__InfluenzaA__ALA08475

SEQ ID NO: 73982 - RNA, 1701 nt, Artificial Sequence
  derived and/or modified sequence opt1 from hemagglutinin__InfluenzaA__ALA08478
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcaagaacugcacccugaucgacgcccugcucggggacccccagugcgacggcuuccagaacaagcggugggaccuguucguggagcgcuccaaggccuacagcaacugcuaccccuacgacgugccggacuacgcgucccugcggagccucgucgccuccagcggcacccuggaguucaacgacgaguccuucaacugggccggggugacgcagaacggcaccagcuccgccugcauccgcgggagcaacuccagcuucuucucccggcugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccagcggccgcaucaccgugagcaccaagcggucccagcaggccgugaucccgaacaucggcagccgcccccggauccgcaacauccccucccggaucagcaucuacuggaccaucgucaagcccggggacauccugcugaucaacuccacgggcaaccucaucgccccgcgcggguacuucaagauccagagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcguggagcucaaguccggcuacaaggacuggauccuguggaucagcuucgccaucagcugcuuccugcucugcgucgcccugcugggguucaucaugugggcgugccagaagggcaacauccggugcaacaucugcaucuga

SEQ ID NO: 73983 - RNA, 1701 nt, Artificial Sequence; identical to SEQ ID NO: 71002
  derived and/or modified sequence opt1 from hemagglutinin__InfluenzaA__ALA08479

SEQ ID NO: 73984 - RNA, 1701 nt, Artificial Sequence
  derived and/or modified sequence opt1 from hemagglutinin__InfluenzaA__ALA08481
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggcccacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagagcagcggccggaucaccguguccaccaagcgcagccagcaggccgugaucccgaacaucggcucccggccccgcauccgggacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagcggcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcgucgagcucaagagcggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 73985 - RNA, 1701 nt, Artificial Sequence; identical to SEQ ID NO: 73984
  derived and/or modified sequence opt1 from hemagglutinin__InfluenzaA__ALA08482

SEQ ID NO: 73986 - RNA, 1701 nt, Artificial Sequence
  derived and/or modified sequence opt1 from hemagglutinin__InfluenzaA__ALA08483
augaagaccaucaucggccugagcuacauccucugccugguguucgcccagaagcugcccgggaacgacaacuccaccgccacgcucugccugggccaccacgcggucccgaacgggaccaucgugaagaccaucaccaacgaccgcaucgaggugacgaacgccaccgagcugguccagaacagcuccaucggcgagaucugcgacagcccccaccagauccucgacggggagaacugcacccugaucgacgcccugcucggcgacccccagugcgacggcuuccagaacaagaagugggaccuguucguggagcgguccaaggccuacagcaacugcuaccccuacgacgugccggacuacgccucccugcgcagccucgucgcguccagcgggacccuggaguucaacaacgaguccuucaacugggccggcgugacgcagaacgggaccagcuccagcugcauccggggcuccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcccagagcagcggccggaucaccguguccaccaagcgcagccagcaggcggugaucccgaacaucgggucccggccccgcauccgggacauccccagccgcaucuccaucuacuggaccaucgucaagcccggcgacauccugcucaucaacagcacggggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacccugaagcucgccacgggcaugcgcaacguccccgagcggcagacccgcgggaucuucggcgcgaucgccggcuucaucgagaacgggugggagggcaugguggacgggugguacggcuuccggcaccagaacagcgaggggcgcggccaggccgccgaccugaaguccacccaggccgcgaucgaccagaucaacggcaagcugaaccggcucaucgggaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgccugcaucggguccauccggaacggcacguacgaccacgacguguaccgcgacgaggcgcucaacaaccgguuccagaucaagggcgucgagcucaagagcggguacaaggacuggauccuguggaucagcuucgccaucuccugcuuccugcugugcguggcccugcucggcuucaucaugugggccugccagaaggggaacauccgcugcaacaucugcaucuga

SEQ ID NO: 73987 - RNA, 1701 nt, Artificial Sequence
  derived and/or modified sequence opt1 from hemagglutinin__InfluenzaA__ALA08484
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccaucagcacgaagcggucccagcaggccgugaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 73988 - RNA, 1701 nt, Artificial Sequence
  derived and/or modified sequence opt1 from hemagglutinin__InfluenzaA__ALA08488
augaagaccaucaucgcccugagcuacauccucugccugguguucgcccagaagauccccggcaacgggaacuccaccgcgacgcugugccucggccaccacgccgucccgaacgggaccaucgugaagaccaucaccaacgaccgcaucgaggugacgaacgccaccgagcugguccagaacagcuccaucggcgagaucugcgacagcccccaccagauccuggacggggagaacugcacccucaucgacgcccugcugggcgacccccagugcgacggcuuccagaacaagaagugggaccucuucguggagcgguccaaggccuacagcaacugcuaccccuacgacgugccggacuacgcgucccugcgcagccuggucgccuccagcgggacccucgaguucaacaacgaguccuucaacuggacgggcgugacccagaacgggaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcggccgcaucaccgugagcacgaagcggucccagcaggccgugaucccgaacaucggcagccgcccccggauccgcgacauccccucccggaucagcaucuacuggaccaucgucaagcccggggacauccugcugaucaacuccaccggcaaccucaucgccccgcgcggguacuucaagauccggagcggcaaguccagcaucaugcgcuccgacgcccccaucggcaagugcaagagcgagugcaucacccccaacggguccauccccaacgacaagccguuccagaacgugaaccggaucacguacggcgccugcccccgcuacgugaagcacagcacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 73989 - RNA, 1701 nt, Artificial Sequence
  derived and/or modified sequence opt1 from hemagglutinin__InfluenzaA__ALA08490
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggaucgagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 73990 - RNA, 1701 nt, Artificial Sequence
  derived and/or modified sequence opt1 from hemagglutinin__InfluenzaA__ALA08491
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacaugaccaugcccaacaacgagcaguucgacaagcucuacaucuggggcgugcaccaccccgggacggacaaggaccagaucuuccuguacgcccagagcuccggccggaucaccgucagcaccaagcgcagccagcaggccgugaucccgaacaucggcucccggccccgcauccggaacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgucaaccgcaucaccuacggcgcgugcccccgguacgugaagcaguccacccugaagcucgccacggggaugcgcaacgugcccgagaagcagacccggggcaucuucggggccaucgccggcuucaucgagaacggcugggaggggaugaaggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 73991 - RNA, 1701 nt, Artificial Sequence; identical to SEQ ID NO: 73989
  derived and/or modified sequence opt1 from hemagglutinin__InfluenzaA__ALA08492

SEQ ID NO: 73992 - RNA, 1701 nt, Artificial Sequence
  derived and/or modified sequence opt1 from hemagglutinin__InfluenzaA__ALA08493
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugccggagcgagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaaggggaucgagcucaaguccggcuacaaggacuggauccuguggaucagcuucgccaucagcugcuuccugcucugcgucgcccugcugggcuucaucaugugggccugccagaaggggaacauccggugcaacaucugcaucuga

SEQ ID NO: 73993 - RNA, 1701 nt, Artificial Sequence
  derived and/or modified sequence opt1 from hemagglutinin__InfluenzaA__ALA08494
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagggcucccagcaggccgugaucccgaacaucggcagccggccccgcauccgggacauccccucccgcaucagcaucuacuggaccaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 73994 - RNA, 1701 nt, Artificial Sequence; identical to SEQ ID NO: 73993
  derived and/or modified sequence opt1 from hemagglutinin__InfluenzaA__ALA08495

SEQ ID NO: 73995 - RNA, 1701 nt, Artificial Sequence; identical to SEQ ID NO: 73993
  derived and/or modified sequence opt1 from hemagglutinin__InfluenzaA__ALA08496

SEQ ID NO: 73996 - RNA, 1701 nt, Artificial Sequence; identical to SEQ ID NO: 73449
  derived and/or modified sequence opt1 from hemagglutinin__InfluenzaA__ALA08497

SEQ ID NO: 73997 - RNA, 1701 nt, Artificial Sequence; identical to SEQ ID NO: 73449
  derived and/or modified sequence opt1 from hemagglutinin__InfluenzaA__ALA08498

SEQ ID NO: 73998 - RNA, 1701 nt, Artificial Sequence
  derived and/or modified sequence opt1 from hemagglutinin__InfluenzaA__ALA08499
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccgggacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaaggucgaccugugguccuacaacgccgagcugcucguggcccuggagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaagggggucgagcucaagagcggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 73999 - RNA, 1701 nt, Artificial Sequence; identical to SEQ ID NO: 73982
  derived and/or modified sequence opt1 from hemagglutinin__InfluenzaA__ALA08501

SEQ ID NO: 74000 - RNA, 1701 nt, Artificial Sequence
  derived and/or modified sequence opt1 from hemagglutinin__InfluenzaA__ALA08502
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaaggucgaccugugguccuacaacgccgagcugcucguggcccuggagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaagggggucgagcucaagagcggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 74001 - RNA, 1701 nt, Artificial Sequence; identical to SEQ ID NO: 74000
  derived and/or modified sequence opt1 from hemagglutinin__InfluenzaA__ALA08503

SEQ ID NO: 74002 - RNA, 1701 nt, Artificial Sequence; identical to SEQ ID NO: 73449
  derived and/or modified sequence opt1 from hemagglutinin__InfluenzaA__ALA08504

SEQ ID NO: 74003 - RNA, 1701 nt, Artificial Sequence; identical to SEQ ID NO: 73449
  derived and/or modified sequence opt1 from hemagglutinin__InfluenzaA__ALA08505

SEQ ID NO: 74004 - RNA, 1701 nt, Artificial Sequence; identical to SEQ ID NO: 73449
  derived and/or modified sequence opt1 from hemagglutinin__InfluenzaA__ALA08506

SEQ ID NO: 74005 - RNA, 1701 nt, Artificial Sequence; identical to SEQ ID NO: 73449
  derived and/or modified sequence opt1 from hemagglutinin__InfluenzaA__ALA08507

SEQ ID NO: 74006 - RNA, 1701 nt, Artificial Sequence
  derived and/or modified sequence opt1 from hemagglutinin__InfluenzaA__ALA08508
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 74007 - RNA, 1701 nt, Artificial Sequence; identical to SEQ ID NO: 73449
  derived and/or modified sequence opt1 from hemagglutinin__InfluenzaA__ALA08509

SEQ ID NO: 74008 - RNA, 1701 nt, Artificial Sequence; identical to SEQ ID NO: 73449
  derived and/or modified sequence opt1 from hemagglutinin__InfluenzaA__ALA08510

SEQ ID NO: 74009 - RNA, 1701 nt, Artificial Sequence
  derived and/or modified sequence opt1 from hemagglutinin__InfluenzaA__ALA08511
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccagcugcauccggcgcuccagcuccagcuucuucucccggcugaacuggcugacccaccucaacuacacguaccccgcccugaacgugaccaugcccaacaacgagcaguucgacaagcuguacaucuggggcguccaccaccccagcaccgacaaggaccagaucuuccucuacgcccagagcuccgggcgcaucaccgugagcacgaagcggucccagcaggcggugaucccgaacaucgggagccgcccccggauccgcgacauccccucccggaucagcaucuacuggaccaucgucaagcccggcgacauccugcugaucaacuccaccggcaaccucaucgccccgcgcggguacuucaagauccggagcggcaaguccagcaucaugcgcuccgacgcccccaucgggaagugcaagagcgagugcaucacccccaacggcuccauccccaacgacaagccguuccagaacgugaaccggaucacguacggcgccugcccccgcuacgugaagcacagcacccugaagcuggccaccgggaugcggaacguccccgagaagcagacccgcggcaucuucggggcgaucgccggcuucaucgagaacgggugggagggcaugguggacggcugguacggguuccggcaccagaacuccgagggccgcgggcaggccgccgaccucaagagcacgcaggccgcgaucgaccagaucaacggcaagcugaaccggcugaucgggaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgccugcaucggcagcauccggaacgggaccuacgaccacaacguguaccgcgacgaggcgcugaacaaccgguuccagaucaagggcgucgagcucaagagcggguacaaggacuggauccuguggaucuccuucgccaucagcugcuuccugcucugcguggcccugcugggcuucaucaugugggccugccagaagggcaacauccgcugcaacaucugcaucuga

SEQ ID NO: 74010 - RNA, 1701 nt, Artificial Sequence; identical to SEQ ID NO: 73449
  derived and/or modified sequence opt1 from hemagglutinin__InfluenzaA__ALA08512

SEQ ID NO: 74011 - RNA, 1701 nt, Artificial Sequence; identical to SEQ ID NO: 73449
  derived and/or modified sequence opt1 from hemagglutinin__InfluenzaA__ALA08514

SEQ ID NO: 74012 - RNA, 1701 nt, Artificial Sequence; identical to SEQ ID NO: 73449
  derived and/or modified sequence opt1 from hemagglutinin__InfluenzaA__ALA08515

SEQ ID NO: 74013 - RNA, 1701 nt, Artificial Sequence; identical to SEQ ID NO: 73449
  derived and/or modified sequence opt1 from hemagglutinin__InfluenzaA__ALA08516

SEQ ID NO: 74014 - RNA, 1701 nt, Artificial Sequence; identical to SEQ ID NO: 74006
  derived and/or modified sequence opt1 from hemagglutinin__InfluenzaA__ALA08517

SEQ ID NO: 74015 - RNA, 1701 nt, Artificial Sequence; identical to SEQ ID NO: 73449
  derived and/or modified sequence opt1 from hemagglutinin__InfluenzaA__ALA08519

SEQ ID NO: 74016 - RNA, 1701 nt, Artificial Sequence
  derived and/or modified sequence opt1 from hemagglutinin__InfluenzaA__ALA08520
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagccguccgggcgcaucaccgugagcacgaagcggagccagcaggccgugauccccaacaucggcucccgcccccggauccgcgacauccccagccggaucuccaucuacuggaccaucgucaagccgggcgacauccugcugaucaacagcaccgggaaccucaucgcgccccgcggcuacuucaagauccggaacgggaaguccagcaucaugcgcuccgacgcccccaucggcaagugcaagagcgagugcaucacccccaacggcuccaucccgaacgacaagcccuuccagaacgugaaccggaucacguacggggccugcccccgcuacgugaagcacagcacccugaagcuggccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74017 - RNA, 1701 nt, Artificial Sequence; identical to SEQ ID NO: 71146
  derived and/or modified sequence opt1 from hemagglutinin__InfluenzaA__ALA08522

SEQ ID NO: 74018 - RNA, 1701 nt, Artificial Sequence
  derived and/or modified sequence opt1 from hemagglutinin__InfluenzaA__ALA08523
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaucgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74019 - RNA, 1701 nt, Artificial Sequence
  derived and/or modified sequence opt1 from hemagglutinin__InfluenzaA__ALA08524
augaagaccaucaucgcccugagcuacauccucugcaugguguucgcccagaagauccccggcaacgacaacuccaccgcgacgcugugccuggggcaccacgccgucccgaacggcaccaucgugaagaccaucaccaacgaccgcaucgaggugacgaacgccaccgagcucguccagaacagcuccaucggggagaucugcgacagcccccaccagauccuggacggcgagaacugcacccugaucgacgcccuccugggggacccccagugcgacggcuuccagaacaagaagugggaccuguucguggagcgguccaaggccuacagcaacugcuaccccuacgacgugccggacuacgcgucccuccgcagccuggucgccuccagcggcacccuggaguucaacaacgaguccuucaacuggacgggggugacccagaacggcaccagcuccgccugcauccggcgcagcuccagcuccuucuucagccggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcaguccagcgggcgcaucaccgugagcacgaagcggucccagcaggccgugaucccgaacaucggcagccgccuccggauccgcgacauccccucccggaucagcaucuacuggaccaucgucaagcccggcgacauccugcugaucaacuccaccgggaaccucaucgcgccccgcggcuacuucaagauccggagcgggaaguccagcaucaugcgcuccgacgccccgaucggcaagugcaagagcgagugcaucacccccaacggcuccauccccaacgacaagcccuuccagaacgugaaccggaucacguacggggccugcccgcgcuacgugaagcacagcacccugaagcuggccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74020 - RNA, 1701 nt, Artificial Sequence; identical to SEQ ID NO: 73449
  derived and/or modified sequence opt1 from hemagglutinin__InfluenzaA__ALA08525

SEQ ID NO: 74021 - RNA, 1701 nt, Artificial Sequence; identical to SEQ ID NO: 73449
  derived and/or modified sequence opt1 from hemagglutinin__InfluenzaA__ALA08526

SEQ ID NO: 74022 - RNA, 1701 nt, Artificial Sequence; identical to SEQ ID NO: 74006
  derived and/or modified sequence opt1 from hemagglutinin__InfluenzaA__ALA08527

SEQ ID NO: 74023 - RNA, 1701 nt, Artificial Sequence
  derived and/or modified sequence opt1 from hemagglutinin__InfluenzaA__ALA08528
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuaccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacagcgagaugaacaagcuguucgagaagaccaagaagcagaugcgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccucuggaucagcuucgccaucuccugcuuccugcugugcgucgcccuccugggcuucaucaugugggcgugccagaaggggaacauccggugcaacaucugcaucuga

SEQ ID NO: 74024 - RNA, 1701 nt, Artificial Sequence; identical to SEQ ID NO: 73449
  derived and/or modified sequence opt1 from hemagglutinin__InfluenzaA__ALA08529

SEQ ID NO: 74025 - RNA, 1701 nt, Artificial Sequence; identical to SEQ ID NO: 73449
  derived and/or modified sequence opt1 from hemagglutinin__InfluenzaA__ALA08530

SEQ ID NO: 74026 - RNA, 1701 nt, Artificial Sequence
  derived and/or modified sequence opt1 from hemagglutinin__InfluenzaA__ALA08531
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacaaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 74027 - RNA, 1701 nt, Artificial Sequence; identical to SEQ ID NO: 73449
  derived and/or modified sequence opt1 from hemagglutinin__InfluenzaA__ALA08532

SEQ ID NO: 74028 - RNA, 1701 nt, Artificial Sequence; identical to SEQ ID NO: 73449
  derived and/or modified sequence opt1 from hemagglutinin__InfluenzaA__ALA08533

SEQ ID NO: 74029 - RNA, 1701 nt, Artificial Sequence; identical to SEQ ID NO: 73449
  derived and/or modified sequence opt1 from hemagglutinin__InfluenzaA__ALA08534

SEQ ID NO: 74030 - RNA, 1701 nt, Artificial Sequence; identical to SEQ ID NO: 73449
  derived and/or modified sequence opt1 from hemagglutinin__InfluenzaA__ALA08535

SEQ ID NO: 74031 - RNA, 1701 nt, Artificial Sequence; identical to SEQ ID NO: 74006
  derived and/or modified sequence opt1 from hemagglutinin__InfluenzaA__ALA08536

SEQ ID NO: 74032 - RNA, 1701 nt, Artificial Sequence; identical to SEQ ID NO: 74006
  derived and/or modified sequence opt1 from hemagglutinin__InfluenzaA__ALA08537

SEQ ID NO: 74033 - RNA, 1701 nt, Artificial Sequence; identical to SEQ ID NO: 74006
  derived and/or modified sequence opt1 from hemagglutinin__InfluenzaA__ALA08538

SEQ ID NO: 74034 - RNA, 1701 nt, Artificial Sequence; identical to SEQ ID NO: 73449
  derived and/or modified sequence opt1 from hemagglutinin__InfluenzaA__ALA08539

SEQ ID NO: 74035 - RNA, 1701 nt, Artificial Sequence; identical to SEQ ID NO: 74006
  derived and/or modified sequence opt1 from hemagglutinin__InfluenzaA__ALA08540

SEQ ID NO: 74036 - RNA, 1701 nt, Artificial Sequence; identical to SEQ ID NO: 74006
  derived and/or modified sequence opt1 from hemagglutinin__InfluenzaA__ALA08541

SEQ ID NO: 74037 - RNA, 1701 nt, Artificial Sequence; identical to SEQ ID NO: 74006
  derived and/or modified sequence opt1 from hemagglutinin__InfluenzaA__ALA08542

SEQ ID NO: 74038 - RNA, 1701 nt, Artificial Sequence
  derived and/or modified sequence opt1 from hemagglutinin__InfluenzaA__ALA08543
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgccaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgucaaccggaucacguacggggcgugcccccgcuacgugaagcacagcacccugaagcuggccaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgcggaccucaagagcacgcaggccgccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggcgugccagaaggggaacauccgcugcaacaucugcaucuga

SEQ ID NO: 74039 - RNA, 1701 nt, Artificial Sequence; identical to SEQ ID NO: 73449
  derived and/or modified sequence opt1 from hemagglutinin__InfluenzaA__ALA08545

SEQ ID NO: 74040 - RNA, 1701 nt, Artificial Sequence; identical to SEQ ID NO: 73449
  derived and/or modified sequence opt1 from hemagglutinin__InfluenzaA__ALA08546

SEQ ID NO: 74041 - RNA, 1701 nt, Artificial Sequence
  derived and/or modified sequence opt1 from hemagglutinin__InfluenzaA__ALA08548
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcguggcccagaacgggacguccagcgcgugcauccggggcuccaacagcuccuucuucagccgccugaacuggcucacccacuccaacuucaaguaccccgcccugaacgugaccaugcccaacaacgagcaguucgacaagcuguacaucuggggcguccaccaccccgggaccgacaaggaccagaucuuccucuacgcccagagcagcgggcggaucacgguguccaccaagcgcagccagcaggccgugaucccgaacaucggcucccggccccgcauccggaacauccccagccgcaucuccaucuacuggaccaucgucaagcccggcgacauccugcugaucaacagcaccgggaaccucaucgccccgcggggcuacuucaagauccgcuccgggaaguccuccaucaugcggagcgacgcgcccaucggcaagugcaaguccgagugcaucacgcccaacggcagcauccccaacgacaagccguuccagaacgugaaccgcaucaccuacggggccugcccccgguacgugaagcaguccacccugaagcuggccaccggcaugcgcaacguccccgagaagcagacgcgggggaucuucggcgccaucgccggguucaucgagaacggcugggagggcaugaaggacgggugguacggcuuccgccaccagaacagcgaggggcggggccaggcggccgaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacaccaagaucgaccugugguccuacaacgccgagcugcucgucgcgcuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagagcggcuacaaggacuggauccuguggaucagcuucgccaucuccugcuuccugcucugcgucgcgcugcugggcuucaucaugugggccugccagaaggggaacauccggugcaacaucugcaucuga

SEQ ID NO: 74042 - RNA, 1701 nt, Artificial Sequence
  derived and/or modified sequence opt1 from hemagglutinin__InfluenzaA__ALA08549
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaccggggugaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgucccggacuacgcgucccugcgcagccugguggccuccagcggcacgcucgaguucaacaacgaguccuucaacuggaccggggugacccagaacggcaccagcuccgccugcauccggcgcagcuccagcuccuucuucagccggcugaacuggcugacgcaccucaacuacaccuaccccgcccugaacgucaccaugcccaacaacgagcaguucgacaagcuguacaucuggggcgugcaccaccccgggaccgacaaggaccagaucuuccucuacgcgcaguccagcgggcgcaucacggugagcaccaagggcucccagcaggccgucaucccgaacaucggcagccggccccgcauccgggacauccccucccgcaucagcaucuacuggaccaucgugaagcccggggacauccugcugaucaacuccaccggcaaccucaucgccccgcggggguacuucaagauccgcagcggcaaguccagcaucaugcgguccgacgcccccaucggcaagugcaagagcgagugcaucacgcccaacggguccauccccaacgacaagccguuccagaacgugaaccgcaucaccuacggcgccugcccccgguacgucaagcacagcacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggccgggggcaggccgccgaccucaagagcacccaggcggccaucgaccagaucaacggcaagcugaaccgccugaucggcaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacacgaucgaccugaccgacuccgagaugaacaagcuguucgagaagacccgcaagcagcuccgcgagaacgccgaggacaugggcaacgggugcuucaagaucuaccacaagugcgacaacgcgugcaucggcagcauccggaacgggaccuacgaccacaacgucuaccgcgacgaggcccugaacaaccgguuccagaucaagggcguggagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 74043 - RNA, 1701 nt, Artificial Sequence; identical to SEQ ID NO: 74006
  derived and/or modified sequence opt1 from hemagglutinin__InfluenzaA__ALA08550

SEQ ID NO: 74044 - RNA, 1701 nt, Artificial Sequence
  derived and/or modified sequence opt1 from hemagglutinin__InfluenzaA__ALA08551
augaagaccaucaucgcccugagcuacauccucugccugguguucgcccagaagcugcucgagaacgacaacuccaccgcgacgcugugccugggccaccacgccguccccaacgggaccaucgugaagaccaucaccagcgaccgcaucgaggugacgaacgccaccgagcucguccagaacuccagcaucggcgagaucugcgacuccccgcaccagauccuggacgggaagaacugcacccugaucgacgcccuccugggcgacccccagugcgacggguuccagaacaagaagugggaccuguucguggagcggagcaaggccuacuccaacugcuaccccuacgacgugcccgacuacgcgagccuccgcucccuggucgccagcuccggcacccuggaguucaacgacgagagcuucaacugggccggcgugacgcagaacgggaccuccagcgccugcauccggggcuccaacagcuccuucuucagccgccucaacuggcugacccacuccaacuucaaguacccggcgcugaacgugaccaugcccaacaacgagcaguucgacaagcucuacaucuggggcguccaccaccccgggacggacaaggaccagaucuuccuguacgcccagagcagcgggcggaucaccguguccaccaagcgcagccagcaggccgugauccccaacaucggcucccggccgcgcauccggaacauccccagccgcaucuccaucuacuggaccaucgucaagcccggcgacauccugcucaucaacagcacggggaaccugaucgcgccccggggcuacuucaagauccgcuccggcaagagcuccaucaugcggagcgacgccccgaucgggaagugcaaguccgagugcaucacccccaacggcagcauccccaacgacaagcccuuccagaacgugaaccgcaucaccuacggggccugcccgcgguacgugaagcaguccacccugaagcucgccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcacguacgaccacaacguguaccgggacgaggcccucaacaaccgcuuccagaucaaggggguggagcucaagagcggcuacaaggacuggauccuguggaucagcuucgccaucuccugcuuccugcugugcgucgcccugcucggcuucaucaugugggcgugccagaaggggaacauccggugcaacaucugcaucuga

SEQ ID NO: 74045 - RNA, 1701 nt, Artificial Sequence; identical to SEQ ID NO: 74006
  derived and/or modified sequence opt1 from hemagglutinin__InfluenzaA__ALA08552

SEQ ID NO: 74046 - RNA, 1701 nt, Artificial Sequence; identical to SEQ ID NO: 74006
  derived and/or modified sequence opt1 from hemagglutinin__InfluenzaA__ALA08553

SEQ ID NO: 74047 - RNA, 1701 nt, Artificial Sequence
  derived and/or modified sequence opt1 from hemagglutinin__InfluenzaA__ALA08554
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucauguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74048 - RNA, 1701 nt, Artificial Sequence
  derived and/or modified sequence opt1 from hemagglutinin__InfluenzaA__ALA08555
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccagaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcgcuccaaggccuacuccaacugcuaccccuacgacgugccggacuacgcgagccugcggucccucgucgccagcuccggcacccuggaguucaacgacgagagcuucaacugggccggcgugacgcagaacgggaccuccagcgccugcauccgcggcuccaacagcuccuucuucagccggcugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcgcaucaccguguccaccaagcggagccagcaggccgugaucccguccaucggcagccgcccccggauccgcaacauccccucccggaucagcaucuacuggaccaucgucaagcccggcgacauccugcugaucaacuccacggggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggcgugcccccgcuacgugaagcagagcacccugaagcuggccacgggcaugcggaacguccccgagaagcagacccgcgggaucuucggcgccaucgccggguucaucgagaacggcugggagggcaugaaggacgggugguacggcuuccggcaccagaacuccgaggggcgcggccaggccgcggaccucaagagcacccaggccgccaucgaccagaucaacgggaagcugaaccggcugaucggcaagaccaacgagaaguuccaccagaucgagaaggaguucuccgagguggagggccgcauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgggagaacgcggaggacauggggaacggcugcuucaagaucuaccacaagugcgacaacgccugcaucgggagcauccgcaacggcacguacgaccacaacguguaccgcgacgaggcccugaacaaccgguuccagaucaaggggguggagcucaagagcggcuacaaggacuggauccuguggaucuccuucgccaucagcugcuuccugcucugcgucgcccugcugggcuucaucaugugggcgugccagaaggggaacauccgcugcaacaucugcaucuga

SEQ ID NO: 74049 - RNA, 1701 nt, Artificial Sequence
  derived and/or modified sequence opt1 from hemagglutinin__InfluenzaA__ALA08556
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacggggaucacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcaguccagcgggcgcaucaccgucagcacgaagcggucccagcaggccgugaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 74050 - RNA, 1701 nt, Artificial Sequence; identical to SEQ ID NO: 74006
  derived and/or modified sequence opt1 from hemagglutinin__InfluenzaA__ALA08557

SEQ ID NO: 74051 - RNA, 1701 nt, Artificial Sequence; identical to SEQ ID NO: 74006
  derived and/or modified sequence opt1 from hemagglutinin__InfluenzaA__ALA08558

SEQ ID NO: 74052 - RNA, 1701 nt, Artificial Sequence
  derived and/or modified sequence opt1 from hemagglutinin__InfluenzaA__ALA08559
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgcuccagcgggcggaucaccgugagcacgaagggcucccagcaggccgugaucccgaacaucggcagccgcccccggauccgcgacauccccucccggaucagcaucuacuggaccaucgucaagcccggggacauccugcugaucaacuccgccggcaaccucaucgccccgcgcggguacuucaagauccggagcggcaaguccagcaucaugcgcuccgacgcccccaucggcaagugcaagagcgagugcaucacccccaacggguccauccccaacgacaagccguuccagaacgugaaccggaucaccuacggcgcgugcccccgcuacgugaagcacagcacgcugaagcuggccaccgggaugcggaacguccccgagaagcagacccgcggcaucuucggggccaucgccggcuucaucgagaacggcugggaggggaugguggacggcugguacggguuccggcaccagaacuccgagggccgcgggcaggccgcggaccucaagagcacccaggccgccaucgaccagaucaacggcaagcugaaccggcugaucggcaagacgaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgcggaggacaugggcaacgggugcuucaagaucuaccacaagugcgacaacgccugcaucggcagcauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggcgugccagaagggcaacauccgcugcaacaucugcaucuga

SEQ ID NO: 74053 - RNA, 1701 nt, Artificial Sequence; identical to SEQ ID NO: 73449
  derived and/or modified sequence opt1 from hemagglutinin__InfluenzaA__ALA08560

SEQ ID NO: 74054 - RNA, 1701 nt, Artificial Sequence
  derived and/or modified sequence opt1 from hemagglutinin__InfluenzaA__ALA08561
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaaggagcaguucgacaagcuguacaucuggggcguccaccaccccgggaccgacaaggaccagaucuuccucuacgcgcaguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74055 - RNA, 1701 nt, Artificial Sequence
  derived and/or modified sequence opt1 from hemagglutinin__InfluenzaA__ALA08563
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccugagcgggaaguccagcaucaugcgguccgacgcccccaucggcaagugcaagagcgagugcaucacccccaacggcuccauccccaacgacaagccguuccagaacgugaaccgcaucacguacggggccugcccccgguacgugaagcacagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacaacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 74056 - RNA, 1701 nt, Artificial Sequence
  derived and/or modified sequence opt1 from hemagglutinin__InfluenzaA__ALA08571
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaccagcugcuuccugcucugcguggcccugcugggcuucaucaugugggccugccagaaggggaacauccgcugcaacaucugcaucuga

SEQ ID NO: 74057 - RNA, 1701 nt, Artificial Sequence; identical to SEQ ID NO: 73992
  derived and/or modified sequence opt1 from hemagglutinin__InfluenzaA__ALA08572

SEQ ID NO: 74058 - RNA, 1701 nt, Artificial Sequence; identical to SEQ ID NO: 73989
  derived and/or modified sequence opt1 from hemagglutinin__InfluenzaA__ALA08573

SEQ ID NO: 74059 - RNA, 1701 nt, Artificial Sequence
  derived and/or modified sequence opt1 from hemagglutinin__InfluenzaA__ALA08574
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucuccgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74060 - RNA, 1701 nt, Artificial Sequence
  derived and/or modified sequence opt1 from hemagglutinin__InfluenzaA__ALA08575
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcagagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74061 - RNA, 1701 nt, Artificial Sequence; identical to SEQ ID NO: 73449
  derived and/or modified sequence opt1 from hemagglutinin__InfluenzaA__ALA08576

SEQ ID NO: 74062 - RNA, 1701 nt, Artificial Sequence; identical to SEQ ID NO: 73449
  derived and/or modified sequence opt1 from hemagglutinin__InfluenzaA__ALA08577

SEQ ID NO: 74063 - RNA, 1701 nt, Artificial Sequence
  derived and/or modified sequence opt1 from hemagglutinin__InfluenzaA__ALA08579
augaagaccaucaucgcccugagcuacauccucugccugaucuucgcccagaagauccccggcaacgacaacuccaccgcgacgcugugccucgggcaccacgccgugccgaacggcaccaucgucaagaccaucaccaacgaccgcaucgaggugacgaacgccaccgagcuggugcagaacagcuccaucggggagaucugcgacagcccccaccagauccuggacggcgagaacugcacccucaucgacgcccugcugggggacccccagugcgacggcuuccagaacaagaagugggaccucuucgucgagcgguccaaggccuacagcaacugcuaccccuacgacgugccggacuacgcgucccugcgcagccugguggccuccagcggcacccucgaguucaacaacgaguccuucaacuggacgggggucacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcgguccagcgggcgcaucaccgucagcacgaagcggucccagcaggccgugaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 74064 - RNA, 1701 nt, Artificial Sequence
  derived and/or modified sequence opt1 from hemagglutinin__InfluenzaA__ALA08580
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgcuccagcgggcggaucaccgugagcacgaagggcucccagcaggccgugaucccgaacaucggcagccgcccccggauccgcgacauccccucccggaucagcaucuacuggaccaucgucaagcccggggacauccugcugaucaacuccaccggcaaccucaucgccccgcgcggguacuucaagauccggagcggcaaguccagcaucaugcgcuccgacgcccccaucggcaagugcaagagcgagugcaucacccccaacggguccauccccaacgacaagccguuccagaacgugaaccggaucacguacggcgccugcccccgcuacgugaagcacagcacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 74065 - RNA, 1701 nt, Artificial Sequence
  derived and/or modified sequence opt1 from hemagglutinin__InfluenzaA__ALA08582
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccgcaucgaggugacgaacgccaccgagcugguccagaacagcuccaucggcgagaucugcgacagcccccaccagauccucgacgggaagaacugcacccugaucgacgcccugcucggcgacccccagugcgacggguuccagaacaagaagugggaccuguucguggagcgguccaaggccuacagcaacugcuaccccuacgacgugccggacuacgcgucccugcgcagccucgucgccuccagcggcacccuggaguucaacgacgaguccuucaacugggccggcgugacgcagaacgggaccagcuccgccugcauccggggcagcaacuccagcuucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccagcgggcggaucaccgugagcaccaagcgcucccagcaggccgugaucccgaacaucggcagccggccccgcauccggaacauccccucccgcaucagcaucuacuggaccaucgucaagcccggcgacauccugcugaucaacuccacggggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucaccuacggggcgugcccccgguacgugaagcagagcacccugaagcuggccacgggcaugcgcaacguccccgagaagcagacccgggggaucuucggcgccaucgccggguucaucgagaacggcugggagggcaugaaggacgggugguacggcuuccgccaccagaacuccgaggggcggggccaggccgcggaccucaagagcacccaggccgccaucgaccagaucaacgggaagcugaaccgccugaucggcaagaccaacgagaaguuccaccagaucgagaaggaguucuccgagguggagggccggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggacauggggaacggcugcuucaagaucuaccacaagugcgacaacgccugcaucgggagcauccgcaacggcacguacgaccacgacguguaccgggacgaggcccugaacaaccgcuuccagaucaaggggguggagcucaaguccggcuacaaggacuggauccuguggaucagcuucgccaucagcugcuuccugcucugcgucgcccugcugggcuucaucaugugggcgugccagaaggggaacauccggugcaacaucugcaucuga

SEQ ID NO: 74066 - RNA, 1701 nt, Artificial Sequence; identical to SEQ ID NO: 74065
  derived and/or modified sequence opt1 from hemagglutinin__InfluenzaA__ALA08583

SEQ ID NO: 74067 - RNA, 1701 nt, Artificial Sequence; identical to SEQ ID NO: 74065
  derived and/or modified sequence opt1 from hemagglutinin__InfluenzaA__ALA08584

SEQ ID NO: 74068 - RNA, 1701 nt, Artificial Sequence; identical to SEQ ID NO: 74065
  derived and/or modified sequence opt1 from hemagglutinin__InfluenzaA__ALA08585

SEQ ID NO: 74069 - RNA, 1701 nt, Artificial Sequence; identical to SEQ ID NO: 73449
  derived and/or modified sequence opt1 from hemagglutinin__InfluenzaA__ALA08586

SEQ ID NO: 74070 - RNA, 1701 nt, Artificial Sequence; identical to SEQ ID NO: 74065
  derived and/or modified sequence opt1 from hemagglutinin__InfluenzaA__ALA08587

SEQ ID NO: 74071 - RNA, 1701 nt, Artificial Sequence; identical to SEQ ID NO: 73449
  derived and/or modified sequence opt1 from hemagglutinin__InfluenzaA__ALA08588

SEQ ID NO: 74072 - RNA, 1701 nt, Artificial Sequence; identical to SEQ ID NO: 73449
  derived and/or modified sequence opt1 from hemagglutinin__InfluenzaA__ALA08589

SEQ ID NO: 74073 - RNA, 1701 nt, Artificial Sequence; identical to SEQ ID NO: 74065
  derived and/or modified sequence opt1 from hemagglutinin__InfluenzaA__ALA08590

SEQ ID NO: 74074 - RNA, 1701 nt, Artificial Sequence; identical to SEQ ID NO: 73449
  derived and/or modified sequence opt1 from hemagglutinin__InfluenzaA__ALA08591

SEQ ID NO: 74075 - RNA, 1701 nt, Artificial Sequence; identical to SEQ ID NO: 74006
  derived and/or modified sequence opt1 from hemagglutinin__InfluenzaA__ALA08592

SEQ ID NO: 74076 - RNA, 1701 nt, Artificial Sequence
  derived and/or modified sequence opt1 from hemagglutinin__InfluenzaA__ALA08594
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccauguccugcuuccugcucugcgucgcccugcugggcuucaucaugugggcgugccagaaggggaacauccggugcaacaucugcaucuga

SEQ ID NO: 74077 - RNA, 1701 nt, Artificial Sequence; identical to SEQ ID NO: 73449
  derived and/or modified sequence opt1 from hemagglutinin__InfluenzaA__ALA08595

SEQ ID NO: 74078 - RNA, 1701 nt, Artificial Sequence; identical to SEQ ID NO: 73449
  derived and/or modified sequence opt1 from hemagglutinin__InfluenzaA__ALA08596

SEQ ID NO: 74079 - RNA, 1701 nt, Artificial Sequence
  derived and/or modified sequence opt1 from hemagglutinin__InfluenzaA__ALA08597
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaacgggaacauccgcugcaacaucugcaucuga

SEQ ID NO: 74080 - RNA, 1701 nt, Artificial Sequence
  derived and/or modified sequence opt1 from hemagglutinin__InfluenzaA__ALA08598
augaagaccaucaucgccagcuccuacauccugugccucguguucgcccagaagauccccggcaacgacaacagcaccgcgacgcugugccuggggcaccacgccgucccgaacggcaccaucgugaagaccaucaccaacgaccgcaucgaggugacgaacgccaccgagcucguccagaacuccagcaucggggagaucugcgacagcccccaccagauccuggacggcgagaacugcacccugaucgacgcccuccugggggacccccagugcgacggcuuccagaacaagaagugggaccuguucguggagcggagcaaggccuacuccaacugcuaccccuacgacgugccggacuacgcgagccuccgcucccuggucgccagcuccggcacccuggaguucaacaacgagagcuucaacuggacgggggugacccagaacggcaccuccagcgccugcauccggcgcuccagcuccagcuucuucucccggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcagagcagcgggcgcaucaccguguccacgaagcggagccagcaggccgugaucccgaacaucggcucccgcccccggauccgcgacauccccagccggaucuccaucuacuggaccaucgucaagcccggcgacauccuccugaucaacagcaccgggaaccugaucgccccgcgcggcuacuucaagauccgguccgggaaguccuccaucaugcgcagcgacgcccccaucggcaagugcaaguccgagugcaucacccccaacggcagcauccccaacgacaagccguuccagaacgugaaccggaucacguacggggccugcccccgcuacgugaagcacuccacccucaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcucaaccggcugaucggcaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcugugcguggcccuccugggcuucaucaugugggccugccagaaggggaacauccgcugcaacaucugcaucuga

SEQ ID NO: 74081 - RNA, 1701 nt, Artificial Sequence; identical to SEQ ID NO: 73449
  derived and/or modified sequence opt1 from hemagglutinin__InfluenzaA__ALA08599

SEQ ID NO: 74082 - RNA, 1701 nt, Artificial Sequence
  derived and/or modified sequence opt1 from hemagglutinin__InfluenzaA__ALA08600
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuaccgcuaccccgcccugaacgugacgaugcccaacaacgagcaguucgacaagcuguacaucuggggcguccaccaccccgggaccgacaaggaccagaucucccucuacgcgcagagcagcgggcggaucaccguguccaccaagcgcagccagcaggccgugaucccgaacaucggcucccggccccgcauccgggacauccccagccgcaucuccaucuacuggacgaucgucaagcccggcgacauccugcugaucaacagcaccgggaaccucaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcacuccacgcugaagcuggcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccucaaguccacccaggcggccaucgaccagaucaacgggaagcugaaccgccugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgggagaacgccgaggacauggggaacggcugcuucaagaucuaccacaagugcgacaacgcgugcaucggguccauccgcaacggcaccuacgaccacaacguguaccgggacgaggcccugaacaaccgcuuccagaucaagggggucgagcucaagagcggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 74083 - RNA, 1701 nt, Artificial Sequence; identical to SEQ ID NO: 73449
  derived and/or modified sequence opt1 from hemagglutinin__InfluenzaA__ALA08601

SEQ ID NO: 74084 - RNA, 1701 nt, Artificial Sequence
  derived and/or modified sequence opt1 from hemagglutinin__InfluenzaA__ALA08602
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacgacuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggcgugacccagaacgggaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucucccucuacgcgcagagcagcggccgcaucaccguguccacgaagcggagccagcaggccgugaucccgaacaucgggucccgcccccggauccgcgacauccccagccggaucuccaucuacuggaccaucgucaagcccggcgacauccugcugaucaacagcaccggcaaccucaucgccccgcgcggguacuucaagauccgguccggcaagagcuccaucaugcgcagcgacgcccccaucgggaagugcaaguccgagugcaucacccccaacggcagcauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacgggugggagggcaugguggacggcugguacggguuccggcaccagaacagcgagggccgcgggcaggccgccgaccucaaguccacgcaggcggccaucgaccagaucaacggcaagcugaaccggcugaucgggaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggguacaaggacuggauccuguggaucagcuucgccaucuccugcuuccugcucugcguggcccugcugggcuucaucaugugggccugccagaagggcaacauccgcugcaacaucugcaucuga

SEQ ID NO: 74085 - RNA, 1701 nt, Artificial Sequence
  derived and/or modified sequence opt1 from hemagglutinin__InfluenzaA__ALA08603
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaucuaccccgcccugaacgugacgaugcccaacaacgagcaguucgacaagcuguacaucuggggcguccaccaccccgggaccgacaaggaccagaucuuccucuacgcgcaguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74086 - RNA, 1701 nt, Artificial Sequence; identical to SEQ ID NO: 73449
  derived and/or modified sequence opt1 from hemagglutinin__InfluenzaA__ALA08605

SEQ ID NO: 74087 - RNA, 1701 nt, Artificial Sequence; identical to SEQ ID NO: 73449
  derived and/or modified sequence opt1 from hemagglutinin__InfluenzaA__ALA08606

SEQ ID NO: 74088 - RNA, 1701 nt, Artificial Sequence; identical to SEQ ID NO: 74064
  derived and/or modified sequence opt1 from hemagglutinin__InfluenzaA__ALA08607

SEQ ID NO: 74089 - RNA, 1701 nt, Artificial Sequence
  derived and/or modified sequence opt1 from hemagglutinin__InfluenzaA__ALA08609
augaagaccaucaucgcccugggcuacauccucugccugguguucgcccagaagauccccgggaacgacaacagcaccgcgacgcugugccucggccaccacgccgucccgaacgggaccaucgugaagaccaucaccaacgaccgcaucgaggugacgaacgccaccgagcugguccagaacuccagcaucggcgagaucugcgacagcccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccagcuccgggacccucgaguucaacaacgagagcuucaacuggacgggcgugacccagaacgggaccuccagcgccugcauccggcgcuccagcuccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugagcacgaagcggagccagcaggccgugaucccgaacaucggcucccgcccccggauccgcgacauccccagccggaucuccaucuacuggaccaucgucaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucagcgagguggaggggcgcauccaggaccucgacaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 74090 - RNA, 1701 nt, Artificial Sequence; identical to SEQ ID NO: 74006
  derived and/or modified sequence opt1 from hemagglutinin__InfluenzaA__ALA08610

SEQ ID NO: 74091 - RNA, 1701 nt, Artificial Sequence
  derived and/or modified sequence opt1 from hemagglutinin__InfluenzaA__ALA08611
augaagaucaucaucgcccugagcuacauccucugccugguguucgcccagaagauccccggcaacgacaacuccaccgcgacccugugccucgggcaccacgccgucccgaacggcacgaucgugaagaccaucaccaacgaccgcaucgaggugaccaacgccacggagcugguccagaacagcuccaucggggagaucugcgacagcccccaccggauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacccucgaguucaacaacgaguccuucaacuggaccggggugacgcagaacggcaccagcuccgccugcauccgccggagcuccagcuccuucuucagccgccugaacuggcugacccaccucaacuacaccuaccccgcccugaacgugacgaugcccaacaacgagcaguucgacaagcuguacaucuggggcguccaccaccccgggaccgacaaggaccagaucuuccucuacgcgcaguccagcgggcggaucaccgugagcaccaagcgcucccagcaggccgugaucccgaacaucggcagccggccccgcauccgggacauccccucccgcaucagcaucuacuggacgaucgucaagcccggcgacauccugcugaucaacuccaccgggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucaccuacggggccugcccccgguacgugaagcacagcacgcugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgggagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74092 - RNA, 1701 nt, Artificial Sequence; identical to SEQ ID NO: 74064
  derived and/or modified sequence opt1 from hemagglutinin__InfluenzaA__ALA08612

SEQ ID NO: 74093 - RNA, 1701 nt, Artificial Sequence; identical to SEQ ID NO: 73449
  derived and/or modified sequence opt1 from hemagglutinin__InfluenzaA__ALA08614

SEQ ID NO: 74094 - RNA, 1701 nt, Artificial Sequence; identical to SEQ ID NO: 73449
  derived and/or modified sequence opt1 from hemagglutinin__InfluenzaA__ALA08615

SEQ ID NO: 74095 - RNA, 1701 nt, Artificial Sequence; identical to SEQ ID NO: 73449
  derived and/or modified sequence opt1 from hemagglutinin__InfluenzaA__ALA08616

SEQ ID NO: 74096 - RNA, 1701 nt, Artificial Sequence; identical to SEQ ID NO: 73989
  derived and/or modified sequence opt1 from hemagglutinin__InfluenzaA__ALA08617

SEQ ID NO: 74097 - RNA, 1701 nt, Artificial Sequence
  derived and/or modified sequence opt1 from hemagglutinin__InfluenzaA__ALA08619
augaagaccgugaucgcccugagcuacauccucugccuggucuucgcccagaagauccccggcaacgacaacuccaccgcgacgcugugccucgggcaccacgccgugccgaacggcaccaucgugaagaccaucaccaacgaccgcaucgaggucacgaacgccaccgagcuggugcagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgucccggacuacgcgucccugcgcagccugaucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgagaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaucuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74098 - RNA, 1701 nt, Artificial Sequence; identical to SEQ ID NO: 74064
  derived and/or modified sequence opt1 from hemagglutinin__InfluenzaA__ALA08620

SEQ ID NO: 74099 - RNA, 1701 nt, Artificial Sequence; identical to SEQ ID NO: 74055
  derived and/or modified sequence opt1 from hemagglutinin__InfluenzaA__ALA08621

SEQ ID NO: 74100 - RNA, 1701 nt, Artificial Sequence
  derived and/or modified sequence opt1 from hemagglutinin__InfluenzaA__ALA08622
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74101 - RNA, 1701 nt, Artificial Sequence; identical to SEQ ID NO: 73449
  derived and/or modified sequence opt1 from hemagglutinin__InfluenzaA__ALA08623

SEQ ID NO: 74102 - RNA, 1701 nt, Artificial Sequence; identical to SEQ ID NO: 74055
  derived and/or modified sequence opt1 from hemagglutinin__InfluenzaA__ALA08624

SEQ ID NO: 74103 - RNA, 1701 nt, Artificial Sequence; identical to SEQ ID NO: 73449
  derived and/or modified sequence opt1 from hemagglutinin__InfluenzaA__ALA08625

SEQ ID NO: 74104 - RNA, 1701 nt, Artificial Sequence; identical to SEQ ID NO: 73449
  derived and/or modified sequence opt1 from hemagglutinin__InfluenzaA__ALA08626

SEQ ID NO: 74105 - RNA, 1701 nt, Artificial Sequence; identical to SEQ ID NO: 73449
  derived and/or modified sequence opt1 from hemagglutinin__InfluenzaA__ALA08627

SEQ ID NO: 74106 - RNA, 1701 nt, Artificial Sequence; identical to SEQ ID NO: 73993
  derived and/or modified sequence opt1 from hemagglutinin__InfluenzaA__ALA08629

SEQ ID NO: 74107 - RNA, 1701 nt, Artificial Sequence
  derived and/or modified sequence opt1 from hemagglutinin__InfluenzaA__ALA08630
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74108 - RNA, 1701 nt, Artificial Sequence
  derived and/or modified sequence opt1 from hemagglutinin__InfluenzaA__ALA08631
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaaggagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74109 - RNA, 1701 nt, Artificial Sequence
  derived and/or modified sequence opt1 from hemagglutinin__InfluenzaA__ALA08632
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagggcucccagcaggccgugaucccgaacgucggcagccggccccgcauccgggacauccccucccgcaucagcaucuacuggaccaucgugaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucacguacggcgccugcccccgguacgucaagcacagcacccugaagcuggcgaccgggaugcgcaacgugcccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacgucuaccgggacgaggcccugaacaaccgcuuccagaucaagggcguggagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 74110 - RNA, 1701 nt, Artificial Sequence; identical to SEQ ID NO: 74006
  derived and/or modified sequence opt1 from hemagglutinin__InfluenzaA__ALA08634

SEQ ID NO: 74111 - RNA, 1701 nt, Artificial Sequence; identical to SEQ ID NO: 73449
  derived and/or modified sequence opt1 from hemagglutinin__InfluenzaA__ALA08635

SEQ ID NO: 74112 - RNA, 1701 nt, Artificial Sequence
  derived and/or modified sequence opt1 from hemagglutinin__InfluenzaA__ALA08636
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucugggggauccaccaccccggcaccgacaaggaccagaucuuccucuacgcgcaguccagcgggcgcaucaccgucagcacgaagcggucccagcaggccgugaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 74113 - RNA, 1701 nt, Artificial Sequence; identical to SEQ ID NO: 74006
  derived and/or modified sequence opt1 from hemagglutinin__InfluenzaA__ALA08637

SEQ ID NO: 74114 - RNA, 1701 nt, Artificial Sequence
  derived and/or modified sequence opt1 from hemagglutinin__InfluenzaA__ALA08638
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgggggagcaacuccagcuucuucucccgccugaacuggcugacccacagcaacuucaaguaccccgcccucaacgugacgaugcccaacaacgagcaguucgacaagcuguacaucuggggcguccaccaccccgggaccgacaaggaccagaucuuccuguacgcgcaguccagcggccggaucaccgugagcaccaagcgcucccagcaggccgugaucccgaacaucggcagccggccccgcauccgggacauccccucccgcaucagcaucuacuggacgaucgucaagcccggggacauccuccugaucaacuccaccggcaaccugaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgccugcccccgguacgugaagcacagcacgcucaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacccaggcggccaucgaccagaucaacggcaagcugaaccgccugaucggcaagacgaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcugaaguccggcuacaaggacuggauccucuggaucagcuucgccaucagcugcuuccugcugugcguggcccuccugggguucaucaugugggccugccagaagggcaacauccggugcaacaucugcaucuga

SEQ ID NO: 74115 - RNA, 1701 nt, Artificial Sequence; identical to SEQ ID NO: 74006
  derived and/or modified sequence opt1 from hemagglutinin__InfluenzaA__ALA08639

SEQ ID NO: 74116 - RNA, 1701 nt, Artificial Sequence; identical to SEQ ID NO: 74006
  derived and/or modified sequence opt1 from hemagglutinin__InfluenzaA__ALA08640

SEQ ID NO: 74117 - RNA, 1701 nt, Artificial Sequence; identical to SEQ ID NO: 74006
  derived and/or modified sequence opt1 from hemagglutinin__InfluenzaA__ALA08641

SEQ ID NO: 74118 - RNA, 1701 nt, Artificial Sequence; identical to SEQ ID NO: 74006
  derived and/or modified sequence opt1 from hemagglutinin__InfluenzaA__ALA08642

SEQ ID NO: 74119 - RNA, 1701 nt, Artificial Sequence; identical to SEQ ID NO: 74006
  derived and/or modified sequence opt1 from hemagglutinin__InfluenzaA__ALA08643

SEQ ID NO: 74120 - RNA, 1701 nt, Artificial Sequence; identical to SEQ ID NO: 73449
  derived and/or modified sequence opt1 from hemagglutinin__InfluenzaA__ALA08644

SEQ ID NO: 74121 - RNA, 1701 nt, Artificial Sequence
  derived and/or modified sequence opt1 from hemagglutinin__InfluenzaA__ALA08645
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgacaucugguccuacaacgccgagcugcuggucgcccucgagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccaucuccugcuuccugcugugcgucgcccuccugggcuucaucaugugggcgugccagaaggggaacauccggugcaacaucugcaucuga

SEQ ID NO: 74122 - RNA, 1701 nt, Artificial Sequence; identical to SEQ ID NO: 73449
  derived and/or modified sequence opt1 from hemagglutinin__InfluenzaA__ALA08646

SEQ ID NO: 74123 - RNA, 1701 nt, Artificial Sequence; identical to SEQ ID NO: 73449
  derived and/or modified sequence opt1 from hemagglutinin__InfluenzaA__ALA08647

SEQ ID NO: 74124 - RNA, 1701 nt, Artificial Sequence; identical to SEQ ID NO: 74006
  derived and/or modified sequence opt1 from hemagglutinin__InfluenzaA__ALA08648

SEQ ID NO: 74125 - RNA, 1701 nt, Artificial Sequence
  derived and/or modified sequence opt1 from hemagglutinin__InfluenzaA__ALA08650
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgagcgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74126 - RNA, 1701 nt, Artificial Sequence; identical to SEQ ID NO: 74006
  derived and/or modified sequence opt1 from hemagglutinin__InfluenzaA__ALA08652

SEQ ID NO: 74127 - RNA, 1701 nt, Artificial Sequence; identical to SEQ ID NO: 73449
  derived and/or modified sequence opt1 from hemagglutinin__InfluenzaA__ALA08653

SEQ ID NO: 74128 - RNA, 1701 nt, Artificial Sequence
  derived and/or modified sequence opt1 from hemagglutinin__InfluenzaA__ALA08654
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaagagcugcuuccugcucugcguggcccugcugggcuucaucaugugggccugccagaaggggaacauccgcugcaacaucugcaucuga

SEQ ID NO: 74129 - RNA, 1701 nt, Artificial Sequence; identical to SEQ ID NO: 74006
  derived and/or modified sequence opt1 from hemagglutinin__InfluenzaA__ALA08655

SEQ ID NO: 74130 - RNA, 1701 nt, Artificial Sequence; identical to SEQ ID NO: 74006
  derived and/or modified sequence opt1 from hemagglutinin__InfluenzaA__ALA08656

SEQ ID NO: 74131 - RNA, 1701 nt, Artificial Sequence
  derived and/or modified sequence opt1 from hemagglutinin__InfluenzaA__ALA08657
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucaucgagcggagcaaggccuacuccaacugcuaccccuacgacgugccggacuacgcgagccugcgcucccucguggccagcuccggcacccuggaguucaacgacgagagcuucaacugggccggcgucacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcgugcaccaccccgggacggacaaggaccagaucuuccucuacgcccagagcagcgggcggaucaccgucuccaccaagcgcagccagcaggccgugaucccgaacaucggcucccggccccgcauccggaacauccccagccgcaucuccaucuacuggaccaucgugaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgucaaccgcaucaccuacggggcgugcccccgguacgugaagcaguccacccugaagcuggccacgggcaugcgcaacgugcccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgaggucgagggccggauccaggaccucgagaaguacguggaggacacgaagaucgaccugugguccuacaacgccgagcugcucguggcccuggagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacgucuaccgggacgaggcccugaacaaccgcuuccagaucaaggggguggagcucaagagcggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 74132 - RNA, 1701 nt, Artificial Sequence; identical to SEQ ID NO: 74006
  derived and/or modified sequence opt1 from hemagglutinin__InfluenzaA__ALA08658

SEQ ID NO: 74133 - RNA, 1701 nt, Artificial Sequence; identical to SEQ ID NO: 73993
  derived and/or modified sequence opt1 from hemagglutinin__InfluenzaA__ALA08659

SEQ ID NO: 74134 - RNA, 1701 nt, Artificial Sequence
  derived and/or modified sequence opt1 from hemagglutinin__InfluenzaA__ALA08660
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacggcacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 74135 - RNA, 1701 nt, Artificial Sequence
  derived and/or modified sequence opt1 from hemagglutinin__InfluenzaA__ALA08662
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccugagcgggaaguccagcaucaugcgguccgacgcccccaucggcaagugcaagagcgagugcaucacccccaacggcuccauccccaacgacaagccguuccagaacgugaaccgcaucacguacggggccugcccccgguacgugaagcacagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccuggagaaguacgucgaggacagcaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucagcuucgccaucuccugcuuccugcugugcguggcccugcucggcuucaucaugugggccugccagaaggggaacauccggugcaacaucugcaucuga

SEQ ID NO: 74136 - RNA, 1701 nt, Artificial Sequence; identical to SEQ ID NO: 74107
  derived and/or modified sequence opt1 from hemagglutinin__InfluenzaA__ALA08663

SEQ ID NO: 74137 - RNA, 1701 nt, Artificial Sequence; identical to SEQ ID NO: 74135
  derived and/or modified sequence opt1 from hemagglutinin__InfluenzaA__ALA08665

SEQ ID NO: 74138 - RNA, 1701 nt, Artificial Sequence
  derived and/or modified sequence opt1 from hemagglutinin__InfluenzaA__ALA08666
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaugagcugcuuccugcugugcguggcccugcucggguucaucaugugggcgugccagaagggcaacauccggugcaacaucugcaucuga

SEQ ID NO: 74139 - RNA, 1701 nt, Artificial Sequence
  derived and/or modified sequence opt1 from hemagglutinin__InfluenzaA__ALA08667
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcgguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74140 - RNA, 1701 nt, Artificial Sequence
  derived and/or modified sequence opt1 from hemagglutinin__InfluenzaA__ALA08668
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggccaucaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 74141 - RNA, 1701 nt, Artificial Sequence; identical to SEQ ID NO: 74107
  derived and/or modified sequence opt1 from hemagglutinin__InfluenzaA__ALA08669

SEQ ID NO: 74142 - RNA, 1701 nt, Artificial Sequence; identical to SEQ ID NO: 74000
  derived and/or modified sequence opt1 from hemagglutinin__InfluenzaA__ALA08670

SEQ ID NO: 74143 - RNA, 1701 nt, Artificial Sequence; identical to SEQ ID NO: 74107
  derived and/or modified sequence opt1 from hemagglutinin__InfluenzaA__ALA08671

SEQ ID NO: 74144 - RNA, 1701 nt, Artificial Sequence; identical to SEQ ID NO: 74107
  derived and/or modified sequence opt1 from hemagglutinin__InfluenzaA__ALA08672

SEQ ID NO: 74145 - RNA, 1701 nt, Artificial Sequence; identical to SEQ ID NO: 74000
  derived and/or modified sequence opt1 from hemagglutinin__InfluenzaA__ALA08673

SEQ ID NO: 74146 - RNA, 1701 nt, Artificial Sequence; identical to SEQ ID NO: 74107
  derived and/or modified sequence opt1 from hemagglutinin__InfluenzaA__ALA08674

SEQ ID NO: 74147 - RNA, 1701 nt, Artificial Sequence; identical to SEQ ID NO: 73449
  derived and/or modified sequence opt1 from hemagglutinin__InfluenzaA__ALA08675

SEQ ID NO: 74148 - RNA, 1701 nt, Artificial Sequence; identical to SEQ ID NO: 74107
  derived and/or modified sequence opt1 from hemagglutinin__InfluenzaA__ALA08676

SEQ ID NO: 74149 - RNA, 1701 nt, Artificial Sequence; identical to SEQ ID NO: 74107
  derived and/or modified sequence opt1 from hemagglutinin__InfluenzaA__ALA08677

SEQ ID NO: 74150 - RNA, 1701 nt, Artificial Sequence; identical to SEQ ID NO: 74107
  derived and/or modified sequence opt1 from hemagglutinin__InfluenzaA__ALA08678

SEQ ID NO: 74151 - RNA, 1701 nt, Artificial Sequence; identical to SEQ ID NO: 74107
  derived and/or modified sequence opt1 from hemagglutinin__InfluenzaA__ALA08679

SEQ ID NO: 74152 - RNA, 1701 nt, Artificial Sequence; identical to SEQ ID NO: 74107
  derived and/or modified sequence opt1 from hemagglutinin__InfluenzaA__ALA08680

SEQ ID NO: 74153 - RNA, 1701 nt, Artificial Sequence; identical to SEQ ID NO: 74006
  derived and/or modified sequence opt1 from hemagglutinin__InfluenzaA__ALA08681

SEQ ID NO: 74154 - RNA, 1701 nt, Artificial Sequence; identical to SEQ ID NO: 74085
  derived and/or modified sequence opt1 from hemagglutinin__InfluenzaA__ALA08682

SEQ ID NO: 74155 - RNA, 1701 nt, Artificial Sequence; identical to SEQ ID NO: 74006
  derived and/or modified sequence opt1 from hemagglutinin__InfluenzaA__ALA08683

SEQ ID NO: 74156 - RNA, 1701 nt, Artificial Sequence
  derived and/or modified sequence opt1 from hemagglutinin__InfluenzaA__ALA08684
augaagaccaucaucgcccugagccacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccagcgggcgcaucaccgugagcaccaagggcucccagcaggccgugaucccgaacaucggcagccggccccgcauccgggacauccccucccgcaucagcaucuacuggacgaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgccugcccccgguacgugaagcacagcacgcugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacccaggcggccaucgaccagaucaacggcaagcugaaccgccugaucggcaagacgaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcaucgagcucaaguccggcuacaaggacuggauccuguggaucagcuucgccaucagcugcuuccugcucugcgucgcccugcugggguucaucaugugggccugccagaagggcaacauccggugcaacaucugcaucuga

SEQ ID NO: 74157 - RNA, 1701 nt, Artificial Sequence; identical to SEQ ID NO: 73449
  derived and/or modified sequence opt1 from hemagglutinin__InfluenzaA__ALA08686

SEQ ID NO: 74158 - RNA, 1701 nt, Artificial Sequence
  derived and/or modified sequence opt1 from hemagglutinin__InfluenzaA__ALA08687
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccugaucgccuccagcggcacccucgaguucaacaacgaguccuucaacuggacgggggucacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcaguccagcgggcgcaucaccgucagcacgaagcggucccagcaggccgugaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 74159 - RNA, 1701 nt, Artificial Sequence; identical to SEQ ID NO: 74100
  derived and/or modified sequence opt1 from hemagglutinin__InfluenzaA__ALA08688

SEQ ID NO: 74160 - RNA, 1701 nt, Artificial Sequence; identical to SEQ ID NO: 73449
  derived and/or modified sequence opt1 from hemagglutinin__InfluenzaA__ALE31612

SEQ ID NO: 74161 - RNA, 1701 nt, Artificial Sequence
  derived and/or modified sequence opt1 from hemagglutinin__InfluenzaA__ALE31613
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagggcucccagcaggccgugaucccgaacaucggcagccggccccgcauccgggacauccccucccgcaucagcaucuacuggaccaucgucaagcccggggacauccugcugaucuccagcaccggcaaccucaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucacguacggcgccugcccccgguacgugaagcacuccacccugaagcuggcgaccgggaugcgcaacguccccgagaagcagacccggggcaucuucggggccaucgccggcuucaucgagaacggcugggaggggaugguggacggcugguacggguuccgccaccagaacagcgagggccgggggcaggccgccgaccucaaguccacgcaggcggccaucgaccagaucaacggcaagcugaaccgccugaucggcaagaccaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccgcaacgggaccuacgaccacaacguguaccgggacgaggcccugaacaaccgcuuccagaucaagggcgucgagcucaagagcggcuacaaggacuggauccuguggaucagcuucgccaucuccugccugcuccugugcguggcccugcucggguucaucaugugggccugccagaagggcaacauccggugcaacaucugcaucuga

SEQ ID NO: 74162 - RNA, 1701 nt, Artificial Sequence
  derived and/or modified sequence opt1 from hemagglutinin__InfluenzaA__ALE31614
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucgggaagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74163 - RNA, 1701 nt, Artificial Sequence
  derived and/or modified sequence opt1 from hemagglutinin__InfluenzaA__ALE31615
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucgaguccauccgcaacggcacguacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 74164 - RNA, 1701 nt, Artificial Sequence; identical to SEQ ID NO: 73449
  derived and/or modified sequence opt1 from hemagglutinin__InfluenzaA__ALE31616

SEQ ID NO: 74165 - RNA, 1701 nt, Artificial Sequence; identical to SEQ ID NO: 73449
  derived and/or modified sequence opt1 from hemagglutinin__InfluenzaA__ALE31617

SEQ ID NO: 74166 - RNA, 1701 nt, Artificial Sequence; identical to SEQ ID NO: 73449
  derived and/or modified sequence opt1 from hemagglutinin__InfluenzaA__ALE31618

SEQ ID NO: 74167 - RNA, 1701 nt, Artificial Sequence; identical to SEQ ID NO: 74107
  derived and/or modified sequence opt1 from hemagglutinin__InfluenzaA__ALE31619

SEQ ID NO: 74168 - RNA, 1701 nt, Artificial Sequence; identical to SEQ ID NO: 73449
  derived and/or modified sequence opt1 from hemagglutinin__InfluenzaA__ALE31620

SEQ ID NO: 74169 - RNA, 1701 nt, Artificial Sequence
  derived and/or modified sequence opt1 from hemagglutinin__InfluenzaA__ALE31622
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgugcccaucggcaagugcaagagcgagugcaucacccccaacggcuccauccccaacgacaagccguuccagaacgugaaccggaucacguacggggccugcccccgcuacgucaagcacagcacccugaagcuggccaccggcaugcggaacgugcccgagaagcagacccgcgggaucuucggcgcgaucgccggguucaucgagaacggcugggagggcaugguggacgggugguacggcuuccggcaccagaacuccgaggggcgcggccaggccgccgaccucaagagcacgcaggccgcgaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggagcauccggaacggcaccuacgaccacaacgucuaccgcgacgaggcgcugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74170 - RNA, 1701 nt, Artificial Sequence; identical to SEQ ID NO: 73449
  derived and/or modified sequence opt1 from hemagglutinin__InfluenzaA__ALE31623

SEQ ID NO: 74171 - RNA, 1701 nt, Artificial Sequence; identical to SEQ ID NO: 73449
  derived and/or modified sequence opt1 from hemagglutinin__InfluenzaA__ALE31625

SEQ ID NO: 74172 - RNA, 1701 nt, Artificial Sequence; identical to SEQ ID NO: 73449
  derived and/or modified sequence opt1 from hemagglutinin__InfluenzaA__ALE31626

SEQ ID NO: 74173 - RNA, 1701 nt, Artificial Sequence; identical to SEQ ID NO: 73449
  derived and/or modified sequence opt1 from hemagglutinin__InfluenzaA__ALE31627

SEQ ID NO: 74174 - RNA, 1701 nt, Artificial Sequence; identical to SEQ ID NO: 73449
  derived and/or modified sequence opt1 from hemagglutinin__InfluenzaA__ALE31628

SEQ ID NO: 74175 - RNA, 1701 nt, Artificial Sequence; identical to SEQ ID NO: 73449
  derived and/or modified sequence opt1 from hemagglutinin__InfluenzaA__ALE31629

SEQ ID NO: 74176 - RNA, 1701 nt, Artificial Sequence; identical to SEQ ID NO: 73449
  derived and/or modified sequence opt1 from hemagglutinin__InfluenzaA__ALE31632

SEQ ID NO: 74177 - RNA, 1701 nt, Artificial Sequence
  derived and/or modified sequence opt1 from hemagglutinin__InfluenzaA__ALE31634
augaagaccaucaucgcccugagcuacauccucugccuggugcuggcccagaagauccccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcuccagcuccuucuucagccggcugaacuggcucacccaccugaacuacacguaccccgcccugaacgugaccaugcccaacaacgagcaguucgacaagcucuacaucuggggcguccaccaccccgggaccgacaaggaccagaucuuccuguacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 74178 - RNA, 1701 nt, Artificial Sequence; identical to SEQ ID NO: 73449
  derived and/or modified sequence opt1 from hemagglutinin__InfluenzaA__ALE31635

SEQ ID NO: 74179 - RNA, 1701 nt, Artificial Sequence; identical to SEQ ID NO: 73449
  derived and/or modified sequence opt1 from hemagglutinin__InfluenzaA__ALE31636

SEQ ID NO: 74180 - RNA, 1701 nt, Artificial Sequence
  derived and/or modified sequence opt1 from hemagglutinin__InfluenzaA__ALE31638
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgggaagccguuccagaacgugaaccggaucacguacggcgccugcccccgcuacgugaagcacagcacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 74181 - RNA, 1701 nt, Artificial Sequence; identical to SEQ ID NO: 73449
  derived and/or modified sequence opt1 from hemagglutinin__InfluenzaA__ALE31639

SEQ ID NO: 74182 - RNA, 1701 nt, Artificial Sequence; identical to SEQ ID NO: 74000
  derived and/or modified sequence opt1 from hemagglutinin__InfluenzaA__ALE31640

SEQ ID NO: 74183 - RNA, 1701 nt, Artificial Sequence; identical to SEQ ID NO: 74006
  derived and/or modified sequence opt1 from hemagglutinin__InfluenzaA__ALE31641

SEQ ID NO: 74184 - RNA, 1701 nt, Artificial Sequence; identical to SEQ ID NO: 74006
  derived and/or modified sequence opt1 from hemagglutinin__InfluenzaA__ALE31642

SEQ ID NO: 74185 - RNA, 1701 nt, Artificial Sequence
  derived and/or modified sequence opt1 from hemagglutinin__InfluenzaA__ALE31643
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaccgccuacuccaacugcuaccccuacgacgugccggacuacgcgagccugcgcucccucgucgccagcuccggcacgcuggaguucaacgacgagagcuucaacugggccggcgugacccagaacgggaccuccagcgccugcauccggggcuccaacagcuccuucuucagccgccugaacuggcucacccacuccaacuucaaguaccccgcgcugaacgugacgaugcccaacaacgagcaguucgacaagcuguacaucuggggcguccaccaccccgggaccgacaaggaccagaucuuccucuacgcccagagcagcgggcggaucaccguguccaccaagcgcagccagcaggccgugaucccgaacaucggcucccggccccgcauccggaacauccccagccgcaucuccaucuacuggacgaucgucaagcccggcgacauccugcugaucaacagcaccgggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacgcugaagcuggccaccggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagacgaacgagaaguuccaccagaucgagaaggaguucagcgagguggagggccggauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 74186 - RNA, 1701 nt, Artificial Sequence; identical to SEQ ID NO: 73449
  derived and/or modified sequence opt1 from hemagglutinin__InfluenzaA__ALE31644

SEQ ID NO: 74187 - RNA, 1701 nt, Artificial Sequence; identical to SEQ ID NO: 73449
  derived and/or modified sequence opt1 from hemagglutinin__InfluenzaA__ALE31645

SEQ ID NO: 74188 - RNA, 1701 nt, Artificial Sequence; identical to SEQ ID NO: 73449
  derived and/or modified sequence opt1 from hemagglutinin__InfluenzaA__ALE31646

SEQ ID NO: 74189 - RNA, 1701 nt, Artificial Sequence; identical to SEQ ID NO: 74006
  derived and/or modified sequence opt1 from hemagglutinin__InfluenzaA__ALE31647

SEQ ID NO: 74190 - RNA, 1701 nt, Artificial Sequence
  derived and/or modified sequence opt1 from hemagglutinin__InfluenzaA__ALE31648
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagccguccgggcgcaucaccgugagcacgaagcggagccagcaggccgugauccccaacaucggcucccgcccccggauccgcgacauccccagccggaucuccaucuacuggaccaucgucaagccgggcgacauccugcugaucaacagcaccgggaaccucaucgcgccccgcggcuacuucaagauccgguccggcaagagcuccaucaugcgcagcgacgcccccaucgggaagugcaaguccgagugcaucacccccaacggcagcaucccgaacgacaagcccuuccagaacgugaaccggaucacguacggggccugcccccgcuacgugaagcacuccacccugaagcuggccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaccgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 74191 - RNA, 1701 nt, Artificial Sequence; identical to SEQ ID NO: 73449
  derived and/or modified sequence opt1 from hemagglutinin__InfluenzaA__ALE31649

SEQ ID NO: 74192 - RNA, 1701 nt, Artificial Sequence; identical to SEQ ID NO: 74006
  derived and/or modified sequence opt1 from hemagglutinin__InfluenzaA__ALE31650

SEQ ID NO: 74193 - RNA, 1701 nt, Artificial Sequence
  derived and/or modified sequence opt1 from hemagglutinin__InfluenzaA__ALE31652
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucucccucuacgcgcagagcagcgggcgcaucaccguguccaccaagcggagccagcaggccgugaucccgaacaucggcucccgcccccggauccgcgacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcacuccacgcugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74194 - RNA, 1701 nt, Artificial Sequence; identical to SEQ ID NO: 74100
  derived and/or modified sequence opt1 from hemagglutinin__InfluenzaA__ALE31653

SEQ ID NO: 74195 - RNA, 1701 nt, Artificial Sequence; identical to SEQ ID NO: 73449
  derived and/or modified sequence opt1 from hemagglutinin__InfluenzaA__ALE31654

SEQ ID NO: 74196 - RNA, 1701 nt, Artificial Sequence; identical to SEQ ID NO: 73449
  derived and/or modified sequence opt1 from hemagglutinin__InfluenzaA__ALE31655

SEQ ID NO: 74197 - RNA, 1701 nt, Artificial Sequence
  derived and/or modified sequence opt1 from hemagglutinin__InfluenzaA__ALE31656
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggacaucuucguggagcgguccaaggccuacagcaacugcuaccccuacgacgugccggacuacgcgucccuccgcagccuggucgccuccagcggcacccuggaguucaacaacgaguccuucaacuggacgggggugacccagaacggcaccagcuccgccugcauccggcgcagcuccagcuccuucuucagccggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccuccugaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccucaagcuggcgaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccucuggagcuacaacgccgagcugcuggucgcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcugaaguccggcuacaaggacuggauccucuggaucagcuucgccaucagcugcuuccugcugugcgucgcccuccugggcuucaucaugugggccugccagaaggggaacauccgcugcaacaucugcaucuga

SEQ ID NO: 74198 - RNA, 1701 nt, Artificial Sequence
  derived and/or modified sequence opt1 from hemagglutinin__InfluenzaA__ALE31657
augaagaccaucaucgcccugagcuacauccucugccugguguccgcccagaagauccccggcaacgacaacagcaccgcgacgcugugccucgggcaccacgccgucccgaacggcaccaucgugaagaccaucaccaacgaccgcaucgaggugacgaacgccaccgagcugguccagaacuccagcaucggggagaucugcgacagcccccaccagauccuggacggcgagaacugcacccucaucgacgcccugcugggggacccccagugcgacggcuuccagaacaagaagugggaccucuucguggagcggagcaaggccuacuccaacugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcagcgggcgcaucaccguguccacgaagcggagccagcaggccgugaucccgaacaucggcucccgcccccggauccgcgacauccccagccggaucuccaucuacuggaccaucgucaagcccggcgacauccugcugaucaacagcaccgggaaccucaucgccccgcgcggcuacuucaagauccgguccgggaaguccuccaucaugcgcagcgacgcccccaucggcaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74199 - RNA, 1701 nt, Artificial Sequence; identical to SEQ ID NO: 73449
  derived and/or modified sequence opt1 from hemagglutinin__InfluenzaA__ALE31658

SEQ ID NO: 74200 - RNA, 1701 nt, Artificial Sequence; identical to SEQ ID NO: 74064
  derived and/or modified sequence opt1 from hemagglutinin__InfluenzaA__ALE31659

SEQ ID NO: 74201 - RNA, 1701 nt, Artificial Sequence; identical to SEQ ID NO: 73993
  derived and/or modified sequence opt1 from hemagglutinin__InfluenzaA__ALE31660

SEQ ID NO: 74202 - RNA, 1701 nt, Artificial Sequence
  derived and/or modified sequence opt1 from hemagglutinin__InfluenzaA__ALE31661
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagaagucccagcaggccgugaucccgaacaucggcagccggccccgcauccgggacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74203 - RNA, 1701 nt, Artificial Sequence
  derived and/or modified sequence opt1 from hemagglutinin__InfluenzaA__ALE31662
augaagaccaucaucgcccugagcuacauccucugccugguguucgcccagaagauccccggcaacgacaacuccaccgcgacgcugugccucgggcaccacgccgucccgaacggcaccaucgugaagaccaucgccaacgaccgcaucgaggugaccaacgccacggagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggcguacagcaacugcuaccccuacgacgugccggacuacgccucccugcgcagccuggucgccuccagcggcacccucgaguucaacaacgaguccuucaacuggaccggggugacgcagaacggcaccagcuccgccugcauccggcgcagcuccagcuccuucuucagccggcugaacuggcugacccaccucaacuacaccuaccccgcgcugaacgugacgaugcccaacaacgagcaguucgacaagcuguacaucuggggcguccaccaccccgggaccgacaaggaccagaucuuccucuacgcccaguccagcgggcgcaucaccgugagcaccaagggcucccagcaggccgugaucccgaacaucggcagccggccccgcauccgggacauccccucccgcaucagcaucuacuggacgaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcacagcacgcugaagcuggccaccgggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagacgaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgcggaggacaugggcaacgggugcuucaagaucuaccacaagugcgacaacgccugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugccugcuccugugcguggcccugcucggguucaucaugugggcgugccagaagggcaacauccggugcaacaucugcaucuga

SEQ ID NO: 74204 - RNA, 1701 nt, Artificial Sequence; identical to SEQ ID NO: 73435
  derived and/or modified sequence opt1 from hemagglutinin__InfluenzaA__ALE31663

SEQ ID NO: 74205 - RNA, 1701 nt, Artificial Sequence
  derived and/or modified sequence opt1 from hemagglutinin__InfluenzaA__ALE31666
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74206 - RNA, 1701 nt, Artificial Sequence
  derived and/or modified sequence opt1 from hemagglutinin__InfluenzaA__ALE31667
augaagaccaucaucgcccugagcuacauccucugccugguguucgcccagaagauccccggcaacgacaacuccaccgcgacgcugugccucgggcaccacgccguccugaacggcaccaucgugaagaccaucaccaacgaccgcaucgaggugacgaacgccaccgagcugguccagaacagcuccaucggggagaucugcgacagcccgcaccagauccucgacggcgagaacugcacccugaucgacgcccugcucggggacccccagugcgacggcuuccagaacaagaagugggaccuguucguggagcgguccaaggccuacagcaacugcuaccccuacgacgugcccgacuacgcgucccugcgcagccucgucgccuccagcggcacccuggaguucaacaacgaguccuucaacuggacgggggugacccagaacggcaccagcuccgccugcauccgcaagagcuccagcuccuucuucagccggcugaacuggcucacccaccugaacuacacguacccggcccugaacgugaccaugcccaacaacgagcaguucgacaagcucuacaucuggggcguccaccaccccgggaccgacaaggaccagaucuuccuguacgcgcgguccagcgggcgcaucaccgugagcacgaagcggucccagcaggccgugauccccaacaucggcagccgcccgcggauccgcgacauccccucccggaucagcaucuacuggaccaucgucaagcccggcgacauccugcucaucaacuccaccgggaaccugaucgcgccccgcggcuacuucaagauccggagcgggaaguccagcaucaugcgcuccgacgccccgaucggcaagugcaagagcgagugcaucacccccaacggcuccauccccaacgacaagcccuuccagaacgugaaccggaucacguacggggccugcccgcgcuacgugaagcacagcacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 74207 - RNA, 1701 nt, Artificial Sequence; identical to SEQ ID NO: 73449
  derived and/or modified sequence opt1 from hemagglutinin__InfluenzaA__ALE31668

SEQ ID NO: 74208 - RNA, 1701 nt, Artificial Sequence; identical to SEQ ID NO: 73449
  derived and/or modified sequence opt1 from hemagglutinin__InfluenzaA__ALE31669

SEQ ID NO: 74209 - RNA, 1701 nt, Artificial Sequence
  derived and/or modified sequence opt1 from hemagglutinin__InfluenzaA__ALE31670
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacagcgagaugaacaagcuguucgagaagaccaagaagcagaugcgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccucuggaucagcuucgccaucuccugcuuccugcugugcgucgcccuccugggcuucaucaugugggcgugccagaaggggaacauccggugcaacaucugcaucuga

SEQ ID NO: 74210 - RNA, 1701 nt, Artificial Sequence; identical to SEQ ID NO: 73449
  derived and/or modified sequence opt1 from hemagglutinin__InfluenzaA__ALE31671

SEQ ID NO: 74211 - RNA, 1701 nt, Artificial Sequence; identical to SEQ ID NO: 73449
  derived and/or modified sequence opt1 from hemagglutinin__InfluenzaA__ALE31672

SEQ ID NO: 74212 - RNA, 1701 nt, Artificial Sequence; identical to SEQ ID NO: 74006
  derived and/or modified sequence opt1 from hemagglutinin__InfluenzaA__ALE31673

SEQ ID NO: 74213 - RNA, 1701 nt, Artificial Sequence
  derived and/or modified sequence opt1 from hemagglutinin__InfluenzaA__ALE31674
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcacuccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74214 - RNA, 1701 nt, Artificial Sequence
  derived and/or modified sequence opt1 from hemagglutinin__InfluenzaA__ALE31675
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcaacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagggcucccagcaggccgugaucccgaacaucggcagccggccccgcauccgggacauccccucccgcaucagcaucuacuggaccaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 74215 - RNA, 1701 nt, Artificial Sequence
  derived and/or modified sequence opt1 from hemagglutinin__InfluenzaA__ALE31676
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgccccaagauccgggacauccccucccgcaucagcaucuacuggaccaucgucaagcccggcgacauccugcugaucaacuccaccgggaaccucaucgccccgcggggcuacuucaagauccugagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacagcaagaucgaccugugguccuacaacgccgagcuccugguggcccuggagaaccagcacaccaucgaccucaccgacagcgagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacaacguguaccgcgacgaggcccucaacaaccgguuccagaucaagggggucgagcucaagagcggcuacaaggacuggauccuguggaucagcuucgccaucuccugcuuccugcugugcguggcccugcucggcuucaucaugugggccugccagaaggggaacauccgcugcaacaucugcaucuga

SEQ ID NO: 74216 - RNA, 1701 nt, Artificial Sequence; identical to SEQ ID NO: 74107
  derived and/or modified sequence opt1 from hemagglutinin__InfluenzaA__ALE31677

SEQ ID NO: 74217 - RNA, 1701 nt, Artificial Sequence; identical to SEQ ID NO: 73449
  derived and/or modified sequence opt1 from hemagglutinin__InfluenzaA__ALE31678

SEQ ID NO: 74218 - RNA, 1701 nt, Artificial Sequence; identical to SEQ ID NO: 73449
  derived and/or modified sequence opt1 from hemagglutinin__InfluenzaA__ALE31679

SEQ ID NO: 74219 - RNA, 1701 nt, Artificial Sequence; identical to SEQ ID NO: 74065
  derived and/or modified sequence opt1 from hemagglutinin__InfluenzaA__ALE31680

SEQ ID NO: 74220 - RNA, 1701 nt, Artificial Sequence; identical to SEQ ID NO: 74064
  derived and/or modified sequence opt1 from hemagglutinin__InfluenzaA__ALE31681

SEQ ID NO: 74221 - RNA, 1701 nt, Artificial Sequence; identical to SEQ ID NO: 73449
  derived and/or modified sequence opt1 from hemagglutinin__InfluenzaA__ALE31682

SEQ ID NO: 74222 - RNA, 1701 nt, Artificial Sequence; identical to SEQ ID NO: 73449
  derived and/or modified sequence opt1 from hemagglutinin__InfluenzaA__ALE31683

SEQ ID NO: 74223 - RNA, 1701 nt, Artificial Sequence; identical to SEQ ID NO: 73449
  derived and/or modified sequence opt1 from hemagglutinin__InfluenzaA__ALE31684

SEQ ID NO: 74224 - RNA, 1701 nt, Artificial Sequence; identical to SEQ ID NO: 73449
  derived and/or modified sequence opt1 from hemagglutinin__InfluenzaA__ALE31685

SEQ ID NO: 74225 - RNA, 1701 nt, Artificial Sequence; identical to SEQ ID NO: 73449
  derived and/or modified sequence opt1 from hemagglutinin__InfluenzaA__ALE31686

SEQ ID NO: 74226 - RNA, 1701 nt, Artificial Sequence
  derived and/or modified sequence opt1 from hemagglutinin__InfluenzaA__ALE31687
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgagagcauccggaacgggaccuacgaccacaacguguaccgcgacgaggcccugaacaaccgguuccagaucaagggcgucgagcucaaguccggguacaaggacuggauccuguggaucagcuucgccaucagcugcuuccugcucugcguggcccugcugggcuucaucaugugggccugccagaagggcaacauccgcugcaacaucugcaucuga

SEQ ID NO: 74227 - RNA, 1701 nt, Artificial Sequence
  derived and/or modified sequence opt1 from hemagglutinin__InfluenzaA__ALE31688
augaagaccaccaucgcccugagcuacauccucugccugguguucgcccagaagcugcccgagaacgacaacuccacggcgacccucugccugggccaccacgccgucccgaacgggaccaucgugaagaccaucacgagcgaccgcaucgaggugaccaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacgcuggaguucaacgacgagagcuucaacugggccggcgugacccagaacgggaccuccagcgccugcauccggggcuccaacagcuccuucuucagccgccugaacuggcucacccacuccaacuucaaguaccccgcgcugaacgugacgaugcccaacaacgagcaguucgacaagcuguacaucuggggcguccaccaccccgggaccgacaaggaccagaucuuccucuacgcccagagcagcgggcggaucaccguguccaccaagcgcagccagcaggccgugaucccgaacaucggcucccggccccgcauccggaacauccccagccgcaucuccaucuacuggacgaucgucaagcccggcgacauccugcugaucaacagcaccgggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacgcugaagcuggccaccggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagacgaacgagaaguuccaccagaucgagaaggaguucagcgagguggagggccggauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 74228 - RNA, 1701 nt, Artificial Sequence; identical to SEQ ID NO: 73449
  derived and/or modified sequence opt1 from hemagglutinin__InfluenzaA__ALE31689

SEQ ID NO: 74229 - RNA, 1701 nt, Artificial Sequence
  derived and/or modified sequence opt1 from hemagglutinin__InfluenzaA__ALE31690
augaagaccaucaucgcccugagcugcauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagagcagcggccggaucaccguguccaccaagcgcagccagcaggccgugaucccgaacaucggcucccggccccgcauccgggacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagcggcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacaacguguaccgcgacgaggcccucaacaaccgguuccagaucaagggcgucgagcucaagagcggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 74230 - RNA, 1701 nt, Artificial Sequence; identical to SEQ ID NO: 71002
  derived and/or modified sequence opt1 from hemagglutinin__InfluenzaA__ALE31691

SEQ ID NO: 74231 - RNA, 1701 nt, Artificial Sequence
  derived and/or modified sequence opt1 from hemagglutinin__InfluenzaA__ALE31692
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcuaccgcccccggauccgcgacauccccagccggaucuccaucuacuggaccaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 74232 - RNA, 1701 nt, Artificial Sequence; identical to SEQ ID NO: 74231
  derived and/or modified sequence opt1 from hemagglutinin__InfluenzaA__ALE31693

SEQ ID NO: 74233 - RNA, 1701 nt, Artificial Sequence; identical to SEQ ID NO: 73449
  derived and/or modified sequence opt1 from hemagglutinin__InfluenzaA__ALE31694

SEQ ID NO: 74234 - RNA, 1701 nt, Artificial Sequence; identical to SEQ ID NO: 74231
  derived and/or modified sequence opt1 from hemagglutinin__InfluenzaA__ALE31695

SEQ ID NO: 74235 - RNA, 1701 nt, Artificial Sequence; identical to SEQ ID NO: 74107
  derived and/or modified sequence opt1 from hemagglutinin__InfluenzaA__ALE31696

SEQ ID NO: 74236 - RNA, 1701 nt, Artificial Sequence; identical to SEQ ID NO: 74231
  derived and/or modified sequence opt1 from hemagglutinin__InfluenzaA__ALE31697

SEQ ID NO: 74237 - RNA, 1701 nt, Artificial Sequence
  derived and/or modified sequence opt1 from hemagglutinin__InfluenzaA__ALE31698
augaagaccaucaucgcccugagcuacauccucugcaugguguucgcccagaagauccccggcaacgacaacuccaccgcgacgcugugccuggggcaccacgccgucccgaacggcaccaucgugaagaccaucaccaacgaccgcaucgaggugacgaacgccaccgagcucguccagaacagcuccaucggggagaucugcgacagcccccaccagauccuggacggcgagaacugcacccugaucgacgcccuccugggggacccccagugcgacggcuuccagaacaagaagugggaccuguucguggagcgguccaaggccuacagcaacugcuaccccuacgacgugccggacuacgcgucccuccgcagccuggucgccuccagcggcacccuggaguucaacaacgaguccuucaacuggacgggggugacccagaacggcaccagcuccgccugcauccggcgcagcuccagcuccuucuucagccggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccuccugaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccucaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 74238 - RNA, 1701 nt, Artificial Sequence
  derived and/or modified sequence opt1 from hemagglutinin__InfluenzaA__ALE31699
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccgaacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccaguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggcgugcccccgcuacgugaagcacagcacgcugaagcuggccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgcggaccucaagagcacccaggccgccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgcggaggacauggggaacggcugcuucaagaucuaccacaagugcgacaacgccugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggcgugccagaaggggaacauccgcugcaacaucugcaucuga

SEQ ID NO: 74239 - RNA, 1701 nt, Artificial Sequence; identical to SEQ ID NO: 73449
  derived and/or modified sequence opt1 from hemagglutinin__InfluenzaA__ALE31700

SEQ ID NO: 74240 - RNA, 1701 nt, Artificial Sequence; identical to SEQ ID NO: 73449
  derived and/or modified sequence opt1 from hemagglutinin__InfluenzaA__ALE31701

SEQ ID NO: 74241 - RNA, 1701 nt, Artificial Sequence; identical to SEQ ID NO: 74006
  derived and/or modified sequence opt1 from hemagglutinin__InfluenzaA__ALE31702

SEQ ID NO: 74242 - RNA, 1701 nt, Artificial Sequence; identical to SEQ ID NO: 73449
  derived and/or modified sequence opt1 from hemagglutinin__InfluenzaA__ALE31703

SEQ ID NO: 74243 - RNA, 1701 nt, Artificial Sequence; identical to SEQ ID NO: 73449
  derived and/or modified sequence opt1 from hemagglutinin__InfluenzaA__ALE31704

SEQ ID NO: 74244 - RNA, 1701 nt, Artificial Sequence; identical to SEQ ID NO: 74006
  derived and/or modified sequence opt1 from hemagglutinin__InfluenzaA__ALE31705

SEQ ID NO: 74245 - RNA, 1701 nt, Artificial Sequence
  derived and/or modified sequence opt1 from hemagglutinin__InfluenzaA__ALE31706
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagggcucccagcaggccgugaucccgaacaucggcagccggccccgcauccgggacauccccucccgcaucagcaucuacuggaccaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugccugcuccugugcguggcccugcucggguucaucaugugggccugccagaagggcaacauccggugcaacaucugcaucuga

SEQ ID NO: 74246 - RNA, 1701 nt, Artificial Sequence; identical to SEQ ID NO: 74135
  derived and/or modified sequence opt1 from hemagglutinin__InfluenzaA__ALE31707

SEQ ID NO: 74247 - RNA, 1701 nt, Artificial Sequence; identical to SEQ ID NO: 74135
  derived and/or modified sequence opt1 from hemagglutinin__InfluenzaA__ALE31708

SEQ ID NO: 74248 - RNA, 1701 nt, Artificial Sequence; identical to SEQ ID NO: 73435
  derived and/or modified sequence opt1 from hemagglutinin__InfluenzaA__ALE31709

SEQ ID NO: 74249 - RNA, 1701 nt, Artificial Sequence
  derived and/or modified sequence opt1 from hemagglutinin__InfluenzaA__ALE31710
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgccugcggauccgcgacauccccucccggaucagcaucuacuggaccaucgucaagcccggcgacauccugcucaucaacuccaccgggaaccugaucgcgccccgcggcuacuucaagauccugagcgggaaguccagcaucaugcgguccgacgccccgaucggcaagugcaagagcgagugcaucacccccaacggcuccauccccaacgacaagcccuuccagaacgugaaccgcaucacguacggggccugcccgcgguacgugaagcacagcacccucaagcuggccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccuggagaaguacgucgaggacagcaagaucgaccucugguccuacaacgccgagcugcugguggcccucgagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccgcaacggcaccuacgaccacaacguguaccgggacgaggcccugaacaaccgcuuccagaucaagggggucgagcucaagagcggcuacaaggacuggauccuguggaucagcuucgccaucuccugcuuccugcugugcguggcccuccugggcuucaucaugugggccugccagaaggggaacauccggugcaacaucugcaucuga

SEQ ID NO: 74250 - RNA, 1701 nt, Artificial Sequence; identical to SEQ ID NO: 74135
  derived and/or modified sequence opt1 from hemagglutinin__InfluenzaA__ALE31711

SEQ ID NO: 74251 - RNA, 1701 nt, Artificial Sequence; identical to SEQ ID NO: 73993
  derived and/or modified sequence opt1 from hemagglutinin__InfluenzaA__ALE31712

SEQ ID NO: 74252 - RNA, 1701 nt, Artificial Sequence
  derived and/or modified sequence opt1 from hemagglutinin__InfluenzaA__ALE31713
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucugggggauccaccaccccggcaccgacaaggaccagaucuuccucuacgcgcgguccagcgggcgcaucaccgucagcacgaagcggucccagcaggccgugaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgucaaccggaucacguacggggccugcccccgcuacgugaagcacagcacccugaagcuggcgaccggcaugcggaacauccccgagaagcagaccaaggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacaacgucuaccgggacgaggcccugaacaaccgcuuccagaucaaggggguggagcucaaguccggcuacaaggacuggauccuguggaucagcuucgccaccagcugcuuccugcucugcguggcccugcugggcuucaucaugugggccugccagaaggggaacauccggugcaacaucugcaucuga

SEQ ID NO: 74253 - RNA, 1701 nt, Artificial Sequence; identical to SEQ ID NO: 74107
  derived and/or modified sequence opt1 from hemagglutinin__InfluenzaA__ALE31714

SEQ ID NO: 74254 - RNA, 1701 nt, Artificial Sequence; identical to SEQ ID NO: 74107
  derived and/or modified sequence opt1 from hemagglutinin__InfluenzaA__ALE31715

SEQ ID NO: 74255 - RNA, 1701 nt, Artificial Sequence; identical to SEQ ID NO: 74135
  derived and/or modified sequence opt1 from hemagglutinin__InfluenzaA__ALE31716

SEQ ID NO: 74256 - RNA, 1701 nt, Artificial Sequence
  derived and/or modified sequence opt1 from hemagglutinin__InfluenzaA__ALE31717
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcgguccagcgggcgcaucaccgugagcaccaagacgucccagcaggccgugaucccgaacaucggcagccggccccgcauccgggacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcacgaccuacggggccugcccccgguacgugaagcacagcacccugaagcuggcgaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74257 - RNA, 1701 nt, Artificial Sequence; identical to SEQ ID NO: 74107
  derived and/or modified sequence opt1 from hemagglutinin__InfluenzaA__ALE31718

SEQ ID NO: 74258 - RNA, 1701 nt, Artificial Sequence
  derived and/or modified sequence opt1 from hemagglutinin__InfluenzaA__ALE31719
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacauccccgagaagcagacccgcgggaucuucggcgccaucgccggguucaucgagaacggcugggagggcauggucgacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 74259 - RNA, 1701 nt, Artificial Sequence; identical to SEQ ID NO: 73993
  derived and/or modified sequence opt1 from hemagglutinin__InfluenzaA__ALE31720

SEQ ID NO: 74260 - RNA, 1701 nt, Artificial Sequence; identical to SEQ ID NO: 74006
  derived and/or modified sequence opt1 from hemagglutinin__InfluenzaA__ALE31721

SEQ ID NO: 74261 - RNA, 1701 nt, Artificial Sequence; identical to SEQ ID NO: 74229
  derived and/or modified sequence opt1 from hemagglutinin__InfluenzaA__ALE31722

SEQ ID NO: 74262 - RNA, 1701 nt, Artificial Sequence
  derived and/or modified sequence opt1 from hemagglutinin__InfluenzaA__ALE31723
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaccacgcccaacggcuccauccccaacgacaagccguuccagaacgugaaccggaucaccuacggggccugcccccgcuacgugaagcacagcacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74263 - RNA, 1701 nt, Artificial Sequence; identical to SEQ ID NO: 73449
  derived and/or modified sequence opt1 from hemagglutinin__InfluenzaA__ALE31724

SEQ ID NO: 74264 - RNA, 1701 nt, Artificial Sequence; identical to SEQ ID NO: 73449
  derived and/or modified sequence opt1 from hemagglutinin__InfluenzaA__ALE31725

SEQ ID NO: 74265 - RNA, 1701 nt, Artificial Sequence; identical to SEQ ID NO: 73449
  derived and/or modified sequence opt1 from hemagglutinin__InfluenzaA__ALE31726

SEQ ID NO: 74266 - RNA, 1701 nt, Artificial Sequence; identical to SEQ ID NO: 73449
  derived and/or modified sequence opt1 from hemagglutinin__InfluenzaA__ALE31727

SEQ ID NO: 74267 - RNA, 1701 nt, Artificial Sequence
  derived and/or modified sequence opt1 from hemagglutinin__InfluenzaA__ALE31728
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccauccccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74268 - RNA, 1701 nt, Artificial Sequence
  derived and/or modified sequence opt1 from hemagglutinin__InfluenzaA__ALE31729
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagaucaucgacggcgagaacugcacccugaucgacgcccuccugggggacccccagugcgacggcuuccagaacaagaagugggaccuguucguggagcgguccaaggccuacagcaacugcuaccccuacgacgugccggacuacgcgucccuccgcagccuggucgccuccagcggcacccuggaguucaacaacgaguccuucaacuggacgggggugacccagaacggcaccagcuccgccugcauccggcgcagcuccagcuccuucuucagccggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccuccugaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccucaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 74269 - RNA, 1701 nt, Artificial Sequence; identical to SEQ ID NO: 73449
  derived and/or modified sequence opt1 from hemagglutinin__InfluenzaA__ALE31730

SEQ ID NO: 74270 - RNA, 1701 nt, Artificial Sequence
  derived and/or modified sequence opt1 from hemagglutinin__InfluenzaA__ALE31731
augaagaccaucaucgcccugagcuacauccucugccagguguucgcccagaagauccccggcaacgacaacuccaccgcgacgcugugccuggggcaccacgccgucccgaacggcaccaucgugaagaccaucaccaacgaccgcaucgaggugacgaacgccaccgagcucguccagaacagcuccaucggggagaucugcgacagcccccaccagauccuggacggcgagaacugcacccugaucgacgcccuccugggggacccccagugcgacggcuuccagaacaagaagugggaccuguucguggagcgguccaaggccuacagcaacugcuaccccuacgacgugccggacuacgcgucccuccgcagccuggucgccuccagcggcacccuggaguucaacaacgaguccuucaacuggacgggggugacccagaacggcaccagcuccgccugcauccgcaagagcuccagcuccuucuucagccggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccuccugaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccucaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 74271 - RNA, 1701 nt, Artificial Sequence; identical to SEQ ID NO: 74107
  derived and/or modified sequence opt1 from hemagglutinin__InfluenzaA__ALE31732

SEQ ID NO: 74272 - RNA, 1701 nt, Artificial Sequence; identical to SEQ ID NO: 74107
  derived and/or modified sequence opt1 from hemagglutinin__InfluenzaA__ALE31733

SEQ ID NO: 74273 - RNA, 1701 nt, Artificial Sequence
  derived and/or modified sequence opt1 from hemagglutinin__InfluenzaA__ALE31734
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcuuccgcccccggauccgcgacauccccagccggaucuccaucuacuggaccaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 74274 - RNA, 1701 nt, Artificial Sequence; identical to SEQ ID NO: 74107
  derived and/or modified sequence opt1 from hemagglutinin__InfluenzaA__ALE31735

SEQ ID NO: 74275 - RNA, 1701 nt, Artificial Sequence; identical to SEQ ID NO: 74006
  derived and/or modified sequence opt1 from hemagglutinin__InfluenzaA__ALE31736

SEQ ID NO: 74276 - RNA, 1701 nt, Artificial Sequence; identical to SEQ ID NO: 74006
  derived and/or modified sequence opt1 from hemagglutinin__InfluenzaA__ALE31737

SEQ ID NO: 74277 - RNA, 1701 nt, Artificial Sequence
  derived and/or modified sequence opt1 from hemagglutinin__InfluenzaA__ALE31738
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccagcgggcgcaucaccgugagcaccaagggcucccagcaggccgugaucccgaacaucggcagccggccccgcauccgggacauccccucccgcaucagcaucuacuggacgaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgccugcccccgguacgugaagcacagcacgcugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacccaggcggccaucgaccagaucaacggcaagcugaaccgccugaucggcaagacgaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 74278 - RNA, 1701 nt, Artificial Sequence; identical to SEQ ID NO: 73449
  derived and/or modified sequence opt1 from hemagglutinin__InfluenzaA__ALE31739

SEQ ID NO: 74279 - RNA, 1701 nt, Artificial Sequence
  derived and/or modified sequence opt1 from hemagglutinin__InfluenzaA__ALE31741
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucuccgagaucugcgacagcccccaccagauccucgacggcaagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcgggacccuggaguucaacgacgaguccuucaacugggccggcgugacgcagaacggcaccagcuccgccugcauccgggggagcaacuccagcuucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccagagcuccggccggaucaccgugagcaccaagcgcucccagcaggccgugaucccgaacaucgggagccggccccgcauccggaacauccccucccgcaucagcaucuacuggaccaucgucaagcccggcgacauccugcugaucaacuccacgggcaaccucaucgccccgcggggguacuucaagauccgcagcggcaaguccagcaucaugcgguccgacgcccccaucgggaagugcaagagcgagugcaucacccccaacggcuccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacgggugggagggcaugaaggacggcugguacggguuccgccaccagaacuccgagggccgggggcaggccgcggaccucaagagcacccaggccgccaucgaccagaucaacggcaagcugaaccgccugaucgggaagaccaacgagaaguuccaccagaucgagaaggaguucuccgagguggagggccggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcguggagcucaagagcggguacaaggacuggauccuguggaucuccuucgccaucagcugcuuccugcucugcgucgcccugcugggcuucaucaugugggcgugccagaagggcaacauccggugcaacaucugcaucuga

SEQ ID NO: 74280 - RNA, 1701 nt, Artificial Sequence
  derived and/or modified sequence opt1 from hemagglutinin__InfluenzaA__ALE31742
augaagaccaucaucgcccugagcuacauccucugccugggcuucgcccagaagauccccgggaacgacaacuccaccgcgacgcugugccucggccaccacgccgugccgaacgggaccaucgucaagaccaucaccaacgaccgcaucgaggugacgaacgccaccgagcuggugcagaacagcuccaucggcgagaucugcgacagcccccaccagauccuggacggggagaacugcacccucaucgacgcccugcugggcgacccccagugcgacggcuuccagaacaagaagugggaccucuucgucgagcgguccaaggccuacagcaacugcuaccccuacgacgugccggacuacgcgucccugcgcagccugguggccuccagcgggacccucgaguucaacaacgaguccuucaacuggacgggcgucacccagaacgggaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcaguccagcggccgcaucaccgucagcacgaagcggucccagcaggccgugaucccgaacaucggcagccgcccccggauccgcgacauccccucccggaucagcaucuacuggaccaucgugaagcccggggacauccugcugaucaacuccaccggcaaccucaucgccccgcgcggguacuucaagauccggagcggcaaguccagcaucaugcgcuccgacgcccccaucggcaagugcaagagcgagugcaucacccccaacggguccauccccaacgacaagccguuccagaacgucaaccgggugacguacggcgccugcccccgcuacgugaagcacagcacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 74281 - RNA, 1701 nt, Artificial Sequence; identical to SEQ ID NO: 74006
  derived and/or modified sequence opt1 from hemagglutinin__InfluenzaA__ALE31743

SEQ ID NO: 74282 - RNA, 1701 nt, Artificial Sequence; identical to SEQ ID NO: 73449
  derived and/or modified sequence opt1 from hemagglutinin__InfluenzaA__ALE31744

SEQ ID NO: 74283 - RNA, 1701 nt, Artificial Sequence
  derived and/or modified sequence opt1 from hemagglutinin__InfluenzaA__ALE31745
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcaagaacugcacccugaucgacgcccugcucggggacccccagugcgacggcuuccagaacaagcggugggaccuguucguggagcgcuccaaggccuacagcaacugcuaccccuacgacgugccggacuacgcgucccugcggagccucgucgccuccagcggcacccuggaguucaacgacgaguccuucaacugggccggggugacgcagaacggcaccagcuccgccugcauccgcgggagcaacuccagcuucuucucccggcugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccagcggccgcaucaccgugagcaccaagcggucccagcaggccgugaucccgaacaucggcagccgccugcggauccgcaacauccccucccggaucagcaucuacuggaccaucgucaagcccggggacauccugcucaucaacuccacgggcaaccugaucgcgccccgcggguacuucaagauccagagcggcaaguccagcaucaugcgguccgacgccccgaucggcaagugcaagagcgagugcaucacccccaacggguccauccccaacgacaagcccuuccagaacgugaacaagaucaccuacggcgccugcccgcgcuacgugaagcagagcacccugaagcucgccacggggaugcggaacguccccgagaagcagacccgcggcaucuucggggccaucgccggcuucaucgagaacggcugggaggggaugaaggacggcugguacggguuccggcaccagaacuccgagggccgcgggcaggccgcggaccucaagagcacccaggccgccaucgaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgggagaacgcggaggacaugggcaacgggugcuucaagaucuaccacaagugcgacaacgccugcaucggcagcauccgcaacgggacguacgaccacgacguguaccgcgacgaggcccucaacaaccgguuccagaucaagggcguggagcugaaguccggcuacaaggacuggauccuguggaucagcuucgccaucagcugcuuccuccugugcgucgcccugcucggguucaucaugugggcgugccagaagggcaacauccgcugcaacaucugcaucuga

SEQ ID NO: 74284 - RNA, 1701 nt, Artificial Sequence
  derived and/or modified sequence opt1 from hemagglutinin__InfluenzaA__ALE31747
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcaagaacugcacccugaucgacgcccugcucggggacccccagugcgacggcuuccagaacaagcggugggaccuguucguggagcgcuccaaggccuacagcaacugcuaccccuacgacgugccggacuacgcgucccugcggagccucgucgccuccagcggcacccuggaguucaacgacgaguccuucaacugggccggggugacgcagaacggcaccagcuccgccugcauccgcgggagcaacuccagcuucuucucccggcugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccagcggccgcaucaccgugagcaccaagcggucccagcaggccgugaucccgaacaucggcagccgcccccggauccgcaacauccccucccggaucagcaucuacuggaccaucgucaagcccggggacauccugcugaucaacuccacgggcaaccucaucgccccgcgcggguacuucaagauccagagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcgggugcaggaccucgagaaguacgucgaggacacgaagaucgaccuguggagcuacaacgccgagcugcucguggcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggcgugccagaagggcaacauccggugcaacaucugcaucuga

SEQ ID NO: 74285 - RNA, 1701 nt, Artificial Sequence; identical to SEQ ID NO: 74006
  derived and/or modified sequence opt1 from hemagglutinin__InfluenzaA__ALE31748

SEQ ID NO: 74286 - RNA, 1701 nt, Artificial Sequence; identical to SEQ ID NO: 73449
  derived and/or modified sequence opt1 from hemagglutinin__InfluenzaA__ALE31749

SEQ ID NO: 74287 - RNA, 1701 nt, Artificial Sequence; identical to SEQ ID NO: 73993
  derived and/or modified sequence opt1 from hemagglutinin__InfluenzaA__ALE31750

SEQ ID NO: 74288 - RNA, 1701 nt, Artificial Sequence
  derived and/or modified sequence opt1 from hemagglutinin__InfluenzaA__ALE31751
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucgacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74289 - RNA, 1701 nt, Artificial Sequence; identical to SEQ ID NO: 73449
  derived and/or modified sequence opt1 from hemagglutinin__InfluenzaA__ALE31752

SEQ ID NO: 74290 - RNA, 1701 nt, Artificial Sequence; identical to SEQ ID NO: 73993
  derived and/or modified sequence opt1 from hemagglutinin__InfluenzaA__ALE31753

SEQ ID NO: 74291 - RNA, 1701 nt, Artificial Sequence; identical to SEQ ID NO: 73449
  derived and/or modified sequence opt1 from hemagglutinin__InfluenzaA__ALE31754

SEQ ID NO: 74292 - RNA, 1701 nt, Artificial Sequence
  derived and/or modified sequence opt1 from hemagglutinin__InfluenzaA__ALE31755
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccagaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcgcagcaaggccuacuccaacugcuaccccuacgacgugccggacuacgcgagccugcggucccucgucgccagcuccggcacccuggaguucaacgacgagagcuucaacugggccggcgugacgcagaacgggaccuccagcgccugcauccgcggcuccaacagcuccuucuucagccggcugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcgcaucaccguguccaccaagcggagccagcaggccgugaucccgaacaucggcucccgcccccggauccgcaacauccccagccggaucuccaucuacuggaccaucgucaagcccggcgacauccugcugaucaacagcacggggaaccucaucgccccgcgcggcuacuucaagauccgguccgggaaguccuccaucaugcgcagcgacgcccccaucggcaagugcaaguccgagugcaucacccccaacggcagcauccccaacgacaagccguuccagaacgugaaccggaucaccuacggggcgugcccccgcuacgugaagcaguccacccugaagcuggccacgggcaugcggaacguccccgagaagcagacccgcgggaucuucggcgccaucgccggguucaucgagaacggcugggagggcaugaaggacgggugguacggcuuccggcaccagaacagcgaggggcgcggccaggccgcggaccucaaguccacccaggccgccaucgaccagaucaacgggaagcugaaccggcugaucggcaagaccaacgagaaguuccaccagaucgagaaggaguucagcgagguggagggccgcauccaggaccucgagaaguacguggaggacacgaagaucgaccugugguccuacaacgccgagcugcucgucgcccuggagaaccagcacaccaucgaccugaccgacagcgagaugaacaagcuguucgagaagaccaagaagcagcuccgggagaacgcggaggacauggggaacggcugcuucaagaucuaccacaagugcgacaacgccugcaucggguccauccgcaacggcacguacgaccacaacguguaccgcgacgaggcccugaacaaccgguuccagaucaaggggguggagcucaagagcggcuacaaggacuggauccuguggaucagcuucgccaucuccugcuuccugcucugcgucgcccugcugggcuucaucaugugggcgugccagaaggggaacauccgcugcaacaucugcaucuga

SEQ ID NO: 74293 - RNA, 1701 nt, Artificial Sequence; identical to SEQ ID NO: 73993
  derived and/or modified sequence opt1 from hemagglutinin__InfluenzaA__ALE31756

SEQ ID NO: 74294 - RNA, 1701 nt, Artificial Sequence; identical to SEQ ID NO: 73449
  derived and/or modified sequence opt1 from hemagglutinin__InfluenzaA__ALE31757

SEQ ID NO: 74295 - RNA, 1701 nt, Artificial Sequence
  derived and/or modified sequence opt1 from hemagglutinin__InfluenzaA__ALE31758
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucguggccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74296 - RNA, 1701 nt, Artificial Sequence
  derived and/or modified sequence opt1 from hemagglutinin__InfluenzaA__ALE31759
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcaagaacugcacccugaucgacgcccugcucggggacccccagugcgacggcuuccagaacaagcggugggaccuguucguggagcgcuccaaggccuacagcaacugcuaccccuacgacgugccggacuacgcgucccugcggagccucgucgccuccagcggcacccuggaguucaacgacgaguccuucaacugggccggggugacgcagaacggcaccagcuccgccugcauccgcgggagcaacuccagcuucuucucccggcugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccagcggccgcgugaccgugagcaccaagcggucccagcaggccgucaucccgaacaucggcagccgcccccggauccgcaacauccccucccggaucagcaucuacuggaccaucgugaagcccggggacauccugcugaucaacuccacgggcaaccucaucgccccgcgcggguacuucaagauccagagcggcaaguccagcaucaugcgguccgacgcccccaucggcaagugcaagagcgagugcaucacccccaacggguccauccccaacaacaagccguuccagaacgugaaccgcaucaccuacggcgcgugcccccgguacgucaagcagagcacccugaagcuggccacggggaugcgcaacgugcccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccucgagaaguacgucgaggacacgaagaucgaccuguggagcuacaacgccgagcugcucguggcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggcgugccagaagggcaacauccggugcaacaucugcaucuga

SEQ ID NO: 74297 - RNA, 1701 nt, Artificial Sequence
  derived and/or modified sequence opt1 from hemagglutinin__InfluenzaA__ALE31760
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcuaccgcccccggauccgcgacauccccagccggaucuccaucuacuggaccaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacgccaagaucgaccugugguccuacaacgccgagcugcucguggcccuggagaaccagcacaccaucgaccugaccgacagcgagaugaacaagcuguucgagaagacgaagaagcagcuccgcgagaacgcggaggacauggggaacggcugcuucaagaucuaccacaagugcgacaacgccugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggcgugccagaaggggaacauccgcugcaacaucugcaucuga

SEQ ID NO: 74298 - RNA, 1701 nt, Artificial Sequence; identical to SEQ ID NO: 73993
  derived and/or modified sequence opt1 from hemagglutinin__InfluenzaA__ALE31761

SEQ ID NO: 74299 - RNA, 1701 nt, Artificial Sequence; identical to SEQ ID NO: 73449
  derived and/or modified sequence opt1 from hemagglutinin__InfluenzaA__ALE31762

SEQ ID NO: 74300 - RNA, 1701 nt, Artificial Sequence; identical to SEQ ID NO: 74055
  derived and/or modified sequence opt1 from hemagglutinin__InfluenzaA__ALE31763

SEQ ID NO: 74301 - RNA, 1701 nt, Artificial Sequence; identical to SEQ ID NO: 74107
  derived and/or modified sequence opt1 from hemagglutinin__InfluenzaA__ALE31764

SEQ ID NO: 74302 - RNA, 1701 nt, Artificial Sequence; identical to SEQ ID NO: 73449
  derived and/or modified sequence opt1 from hemagglutinin__InfluenzaA__ALE31765

SEQ ID NO: 74303 - RNA, 1701 nt, Artificial Sequence
  derived and/or modified sequence opt1 from hemagglutinin__InfluenzaA__ALE31774
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagguguuccucuacgcgcaguccagcgggcgcaucaccgugagcacgaagcggucccagcaggccgucaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74304 - RNA, 1701 nt, Artificial Sequence
  derived and/or modified sequence opt1 from hemagglutinin__InfluenzaA__ALE31775
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgaguuccugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 74305 - RNA, 1701 nt, Artificial Sequence
  derived and/or modified sequence opt1 from hemagglutinin__InfluenzaA__ALE31776
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgccuccaucggcaagugcaagagcgagugcaucacccccaacggcuccauccccaacgacaagcccuuccagaacgugaaccgcaucaccuacggggcgugcccgcgguacgugaagcagagcacccugaagcuggccacgggcaugcgcaacguccccgagaagcagacccgggggaucuucggcgccaucgccggguucaucgagaacggcugggagggcaugaaggacgggugguacggcuuccgccaccagaacuccgaggggcggggccaggccgcggaccucaagagcacccaggccgccaucgaccagaucaacgggaagcugaaccgccugaucggcaagaccaacgagaaguuccaccagaucgagaaggaguucuccgagguggagggccggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggacauggggaacggcugcuucaagaucuaccacaagugcgacaacgccugcaucgggagcauccgcaacggcacguacgaccacgacguguaccgggacgaggcccugaacaaccgcuuccagaucaaggggguggagcucaagagcggcuacaaggacuggauccuguggaucuccuucgccaucagcugcuuccugcucugcgucgcccugcugggcuucaucaugugggcgugccagaaggggaacauccggugcaacaucugcaucuga

SEQ ID NO: 74306 - RNA, 1701 nt, Artificial Sequence
  derived and/or modified sequence opt1 from hemagglutinin__InfluenzaA__ALE31777
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccguggucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74307 - RNA, 1701 nt, Artificial Sequence; identical to SEQ ID NO: 74055
  derived and/or modified sequence opt1 from hemagglutinin__InfluenzaA__ALE31778

SEQ ID NO: 74308 - RNA, 1701 nt, Artificial Sequence; identical to SEQ ID NO: 73449
  derived and/or modified sequence opt1 from hemagglutinin__InfluenzaA__ALE31779

SEQ ID NO: 74309 - RNA, 1701 nt, Artificial Sequence
  derived and/or modified sequence opt1 from hemagglutinin__InfluenzaA__ALE31780
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggcccacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcaccgacgcccccaucggcaagugcaaguccgagugcaucacgcccaacggcagcauccccaacgacaagccguuccagaacgugaaccggaucaccuacggggccugcccccgcuacgugaagcacuccacccugaagcuggcgaccggcaugcggaacguccccgagaagcagacgcgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 74310 - RNA, 1701 nt, Artificial Sequence
  derived and/or modified sequence opt1 from hemagglutinin__InfluenzaA__ALE31781
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcggcagcccccaccagauccuggacggggagaacugcacccucaucgacgcccugcugggcgacccccagugcgacggcuuccagaacaagaagugggaccucuucguggagcgguccaaggccuacagcaacugcuaccccuacgacgugccggacuacgcgucccugcgcagccuggucgccuccagcgggacccucgaguucaacaacgaguccuucaacuggacgggcgugacccagaacgggaccagcuccgccugcauccgcaagagcuccagcuccuucuucagcaagcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcggccggaucaccgugagcacgaagcgcucccagcaggccgugaucccgaacaucggcagccggccccgcauccgggacauccccucccgcaucagcaucuacuggaccaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 74311 - RNA, 1701 nt, Artificial Sequence
  derived and/or modified sequence opt1 from hemagglutinin__InfluenzaA__ALE31782
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgucucccugcgcagccugguggcguccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgucaccaugcccaacaacgagcaguucgacaagcuguacaucuggggcgugcaccaccccgggaccgacaaggaccagaucuuccucuacgcccaguccagcgggcgcaucaccgugagcacgaagcggucccagcaggcggucaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgucaagcagagcacccugaagcuggccaccggcaugcggaacgugcccgagaagcagacccgcgggaucuucggcgcgaucgccggguucaucgagaacggcugggagggcaugguggacgggugguacggcuuccggcaccagaacuccgaggggcgcggccaggccgccgaccucaagagcacgcaggccgcgaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggagcauccggaacggcaccuacgaccacaacgucuaccgcgacgaggcgcugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74312 - RNA, 1701 nt, Artificial Sequence
  derived and/or modified sequence opt1 from hemagglutinin__InfluenzaA__ALE31783
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccguccccaacaacgagcaguucgacaagcuguacaucuggggcgugcaccaccccgggaccgacaaggaccagaucuuccucuacgcgcaguccagcgggcgcaucaccgugagcacgaagcggucccagcaggccgucaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74313 - RNA, 1701 nt, Artificial Sequence; identical to SEQ ID NO: 74065
  derived and/or modified sequence opt1 from hemagglutinin__InfluenzaA__ALE31784

SEQ ID NO: 74314 - RNA, 1701 nt, Artificial Sequence; identical to SEQ ID NO: 73449
  derived and/or modified sequence opt1 from hemagglutinin__InfluenzaA__ALE31785

SEQ ID NO: 74315 - RNA, 1701 nt, Artificial Sequence; identical to SEQ ID NO: 74055
  derived and/or modified sequence opt1 from hemagglutinin__InfluenzaA__ALE31786

SEQ ID NO: 74316 - RNA, 1701 nt, Artificial Sequence; identical to SEQ ID NO: 74107
  derived and/or modified sequence opt1 from hemagglutinin__InfluenzaA__ALE31787

SEQ ID NO: 74317 - RNA, 1701 nt, Artificial Sequence; identical to SEQ ID NO: 73549
  derived and/or modified sequence opt1 from hemagglutinin__InfluenzaA__ALE31788

SEQ ID NO: 74318 - RNA, 1701 nt, Artificial Sequence; identical to SEQ ID NO: 73449
  derived and/or modified sequence opt1 from hemagglutinin__InfluenzaA__ALE31789

SEQ ID NO: 74319 - RNA, 1701 nt, Artificial Sequence; identical to SEQ ID NO: 74064
  derived and/or modified sequence opt1 from hemagglutinin__InfluenzaA__ALE31790

SEQ ID NO: 74320 - RNA, 1701 nt, Artificial Sequence; identical to SEQ ID NO: 74185
  derived and/or modified sequence opt1 from hemagglutinin__InfluenzaA__ALE31791

SEQ ID NO: 74321 - RNA, 1701 nt, Artificial Sequence; identical to SEQ ID NO: 74085
  derived and/or modified sequence opt1 from hemagglutinin__InfluenzaA__ALE31792

SEQ ID NO: 74322 - RNA, 1701 nt, Artificial Sequence
  derived and/or modified sequence opt1 from hemagglutinin__InfluenzaA__ALE31793
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucucccucuacgcgcagagcagcgggcgcaucaccguguccacgaagcggagccagcaggccgugaucccgaacaucggcucccgcccccggauccgcgacauccccagccggaucuccaucuacuggaccaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74323 - RNA, 1701 nt, Artificial Sequence; identical to SEQ ID NO: 73449
  derived and/or modified sequence opt1 from hemagglutinin__InfluenzaA__ALE31794

SEQ ID NO: 74324 - RNA, 1701 nt, Artificial Sequence; identical to SEQ ID NO: 73449
  derived and/or modified sequence opt1 from hemagglutinin__InfluenzaA__ALE31795

SEQ ID NO: 74325 - RNA, 1701 nt, Artificial Sequence; identical to SEQ ID NO: 73449
  derived and/or modified sequence opt1 from hemagglutinin__InfluenzaA__ALE31796

SEQ ID NO: 74326 - RNA, 1701 nt, Artificial Sequence; identical to SEQ ID NO: 74107
  derived and/or modified sequence opt1 from hemagglutinin__InfluenzaA__ALE31797

SEQ ID NO: 74327 - RNA, 1701 nt, Artificial Sequence; identical to SEQ ID NO: 74107
  derived and/or modified sequence opt1 from hemagglutinin__InfluenzaA__ALE31798

SEQ ID NO: 74328 - RNA, 1701 nt, Artificial Sequence; identical to SEQ ID NO: 73449
  derived and/or modified sequence opt1 from hemagglutinin__InfluenzaA__ALE31799

SEQ ID NO: 74329 - RNA, 1701 nt, Artificial Sequence; identical to SEQ ID NO: 74055
  derived and/or modified sequence opt1 from hemagglutinin__InfluenzaA__ALE31800

SEQ ID NO: 74330 - RNA, 1701 nt, Artificial Sequence; identical to SEQ ID NO: 73449
  derived and/or modified sequence opt1 from hemagglutinin__InfluenzaA__ALE31801

SEQ ID NO: 74331 - RNA, 1701 nt, Artificial Sequence; identical to SEQ ID NO: 73449
  derived and/or modified sequence opt1 from hemagglutinin__InfluenzaA__ALE31802

SEQ ID NO: 74332 - RNA, 1701 nt, Artificial Sequence; identical to SEQ ID NO: 74055
  derived and/or modified sequence opt1 from hemagglutinin__InfluenzaA__ALE31803

SEQ ID NO: 74333 - RNA, 1701 nt, Artificial Sequence; identical to SEQ ID NO: 74006
  derived and/or modified sequence opt1 from hemagglutinin__InfluenzaA__ALE31805

SEQ ID NO: 74334 - RNA, 1701 nt, Artificial Sequence
  derived and/or modified sequence opt1 from hemagglutinin__InfluenzaA__ALE31806
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacacccugcugaucaacuccaccgggaaccucaucgccccgcgcggcuacuucaagauccggagcgggaaguccagcaucaugcgcuccgacgcccccaucggcaagugcaagagcgagugcaucacgcccaacggcuccauccccaacgacaagccguuccagaacgugaaccggaucaccuacggggccugcccccgcuacgugaagcacagcacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74335 - RNA, 1701 nt, Artificial Sequence
  derived and/or modified sequence opt1 from hemagglutinin__InfluenzaA__ALE31807
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcuccagcuccuucuucagccggcugaacuggcucacccaccugaacuucacguaccccgcccugaacgugaccaugcccaacaacgagcaguucgacaagcucuacgucuggggcgugcaccaccccgggaccgacaaggaccagaucuuccuguacgcgcaguccagcgggcgcaucaccgugagcacgaagcggucccagcaggccgucaucccgaacaucggcagccgcccccggauccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgucaagcacagcacccugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacaacgucuaccgcgacgaggcccucaacaaccgguuccagaucaaggggguggagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 74336 - RNA, 1701 nt, Artificial Sequence
  derived and/or modified sequence opt1 from hemagglutinin__InfluenzaA__ALE31808
augaagaccaucaucgcccugggcuacauccucugccugguguucgcccagaagauccccgggaacgacaacagcaccgcgacgcugugccucggccaccacgccgucccgaacgggaccaucgugaagaccaucaccaacgaccgcaucgaggugacgaacgccaccgagcugguccagaacuccagcaucggcgagaucugcgacagcccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccagcuccgggacccucgaguucaacaacgagagcuucaacuggacgggcgugacccagaacgggaccuccagcgccugcauccggcgcuccagcuccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugagcacgaagcggagccagcaggccgugaucccgaacaucggcucccgcccccggauccgcgacauccccagccggaucuccaucuacuggaccaucgucaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 74337 - RNA, 1701 nt, Artificial Sequence; identical to SEQ ID NO: 73449
  derived and/or modified sequence opt1 from hemagglutinin__InfluenzaA__ALE31810

SEQ ID NO: 74338 - RNA, 1701 nt, Artificial Sequence; identical to SEQ ID NO: 73449
  derived and/or modified sequence opt1 from hemagglutinin__InfluenzaA__ALE31812

SEQ ID NO: 74339 - RNA, 1701 nt, Artificial Sequence
  derived and/or modified sequence opt1 from hemagglutinin__InfluenzaA__ALE31814
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcaagaacugcacccugaucgacgcccugcucggggacccccagugcgacggcuuccagaacaagaagugggaccuguucguggagcgguccaaggcccacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgagcggccggaucaccgugagcaccaagcgcucccagcaggccgugauccccaacaucggcagccggccccgcauccgggacauccccucccgcaucagcaucuacuggaccaucgucaagccgggggacauccugcucaucaacuccacgggcaaccugaucgcgccccggggguacuucaagauccgcagcggcaaguccagcaucaugcgguccgacgcccccaucggcaagugcaagagcgagugcaucacccccaacggguccaucccgaacgacaagcccuuccagaacgugaaccgcaucaccuacggcgccugcccccgguacgugaagcagagcacccugaagcucgccacggggaugcgcaacguccccgagcggcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcgucgagcugaaguccggcuacaaggacuggauccuguggaucagcuucgccaucagcugcuuccuccugugcguggcccugcucggguucaucaugugggccugccagaagggcaacauccgcugcaacaucugcaucuga

SEQ ID NO: 74340 - RNA, 1701 nt, Artificial Sequence; identical to SEQ ID NO: 74339
  derived and/or modified sequence opt1 from hemagglutinin__InfluenzaA__ALE31815

SEQ ID NO: 74341 - RNA, 1701 nt, Artificial Sequence; identical to SEQ ID NO: 73449
  derived and/or modified sequence opt1 from hemagglutinin__InfluenzaA__ALE31818

SEQ ID NO: 74342 - RNA, 1701 nt, Artificial Sequence
  derived and/or modified sequence opt1 from hemagglutinin__InfluenzaA__ALE31819
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgggggagcuccagcuccuucuucagccgccugaacuggcugacccaccucaacuacacguaccccgcccugaacgugaccaugcccaacaaggagcaguucgacaagcuguacaucuggggcguccaccaccccgggaccgacaaggaccagaucuuccucuacgcgcaguccagcggccggaucaccgugagcacgaagcgcucccagcaggccgugaucccgaacaucggcagccggccccgcauccgggacauccccucccgcaucagcaucuacuggaccaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 74343 - RNA, 1701 nt, Artificial Sequence; identical to SEQ ID NO: 73993
  derived and/or modified sequence opt1 from hemagglutinin__InfluenzaA__ALE31820

SEQ ID NO: 74344 - RNA, 1701 nt, Artificial Sequence
  derived and/or modified sequence opt1 from hemagglutinin__InfluenzaA__ALE31821
augaagaccaucaucgcccugagcuacacccucugccugguguucgcccagaagauccccggcaacgacaacuccacggcgacccugugccucgggcaccacgccgucccgaacggcaccaucgugaagaccaucacgaacgaccgcaucgaggugaccaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggcccacagcaacugcuaccccuacgacgugccggacuacgcgucccugcgcagccuggucgccuccagcggcacgcucgaguucaacaacgaguccuucaacuggaccggggugacccagaacggcaccagcuccgccugcauccggcgcagcuccagcuccuucuucagccggcugaacuggcugacgcaccucaacuacaccuaccccgcccugaacgugaccaugcccaacaacgagcaguucgacaagcuguacaucuggggcguccaccaccccgggaccgacaaggaccagaucuuccucuacgcgcaguccagcgggcgcaucacggugagcaccaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacgcccaacggcuccauccccaacgacaagccguuccagaacgugaaccggaucaccuacggggccugcccccgcuacgugaagcacagcacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74345 - RNA, 1701 nt, Artificial Sequence; identical to SEQ ID NO: 74085
  derived and/or modified sequence opt1 from hemagglutinin__InfluenzaA__ALE31822

SEQ ID NO: 74346 - RNA, 1701 nt, Artificial Sequence; identical to SEQ ID NO: 73993
  derived and/or modified sequence opt1 from hemagglutinin__InfluenzaA__ALE31823

SEQ ID NO: 74347 - RNA, 1701 nt, Artificial Sequence; identical to SEQ ID NO: 73449
  derived and/or modified sequence opt1 from hemagglutinin__InfluenzaA__ALE31824

SEQ ID NO: 74348 - RNA, 1701 nt, Artificial Sequence
  derived and/or modified sequence opt1 from hemagglutinin__InfluenzaA__ALE31825
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuaccgcuaccccgcccugaacgugacgaugcccaacaacgagcaguucgacaagcuguacaucuggggcguccaccaccccgggaccgacaaggaccagaucuuccucuacgcgcaguccagcgggcggaucaccgugagcaccaagcgcucccagcaggccgugaucccgaacaucggcagccggccccgcauccgggacauccccucccgcaucagcaucuacuggacgaucgucaagcccggcgacauccugcugaucaacuccaccgggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucaccuacggggccugcccccgguacgugaagcacagcacgcugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgggagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74349 - RNA, 1701 nt, Artificial Sequence; identical to SEQ ID NO: 73449
  derived and/or modified sequence opt1 from hemagglutinin__InfluenzaA__ALE31826

SEQ ID NO: 74350 - RNA, 1701 nt, Artificial Sequence; identical to SEQ ID NO: 73449
  derived and/or modified sequence opt1 from hemagglutinin__InfluenzaA__ALE31827

SEQ ID NO: 74351 - RNA, 1701 nt, Artificial Sequence; identical to SEQ ID NO: 73449
  derived and/or modified sequence opt1 from hemagglutinin__InfluenzaA__ALE31828

SEQ ID NO: 74352 - RNA, 1701 nt, Artificial Sequence; identical to SEQ ID NO: 74006
  derived and/or modified sequence opt1 from hemagglutinin__InfluenzaA__ALE31829

SEQ ID NO: 74353 - RNA, 1701 nt, Artificial Sequence
  derived and/or modified sequence opt1 from hemagglutinin__InfluenzaA__ALE31830
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgacaucacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 74354 - RNA, 1701 nt, Artificial Sequence
  derived and/or modified sequence opt1 from hemagglutinin__InfluenzaA__ALE31832
augaagaacaucaucgcccugagcuacauccucugccugguguucgcccagaagauccccggcaacgacaacuccaccgcgacccugugccucgggcaccacgccgucccgaacggcacgaucgugaagaccaucaccaacgaccgcaucgaggugaccaacgccacggagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggaccggggugacgcagaacggcaccagcuccgccugcauccggcgcagcaacuccagcuucuucucccggcugaacuggcugacccaccucaacuacaccuaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcgacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcacuccacgcugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 74355 - RNA, 1701 nt, Artificial Sequence
  derived and/or modified sequence opt1 from hemagglutinin__InfluenzaA__ALE31833
augaagaccaucaucgcccugagcuacauccucugccugguguccgcccagaagauccccggcaacgacaacagcaccgcgacgcugugccucgggcaccacgccgucccgaacggcaccaucgugaagaccaucaccaacgaccgcaucgaggugacgaacgccaccgagcugguccagaacuccagcaucggggagaucugcaacagcccccaccagauccuggacggcgagaacugcacccucaucgacgcccugcugggggacccccagugcgacggcuuccagaacaagaagugggaccucuucguggagcggagcaaggccuacuccaacugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcagcgggcgcaucaccguguccacgaagcggagccagcaggccgugaucccgaacaucggcucccgcccccggauccgcgacauccccagccggaucuccaucuacuggaccaucgucaagcccggcgacauccugcugaucaacagcaccgggaaccucaucgccccgcgcggcuacuucaagauccgguccgggaaguccuccaucaugcgcagcgacgcccccaucggcaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74356 - RNA, 1701 nt, Artificial Sequence
  derived and/or modified sequence opt1 from hemagglutinin__InfluenzaA__ALE31834
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggcccacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagagcagcggccggaucaccguguccaccaagcgcagccagcaggccgugaucccgaacaucggcucccggccccgcauccgggacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagaagcagacccggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcucaagagcggcuacaaggacuggauccuguggaucagcuucgccaucuccugcuuccugcugugcguggcccugcucggguucaucaugugggccugccagaagggcaacauccggugcaacaucugcaucuga

SEQ ID NO: 74357 - RNA, 1701 nt, Artificial Sequence; identical to SEQ ID NO: 74107
  derived and/or modified sequence opt1 from hemagglutinin__InfluenzaA__ALE31835

SEQ ID NO: 74358 - RNA, 1701 nt, Artificial Sequence; identical to SEQ ID NO: 73449
  derived and/or modified sequence opt1 from hemagglutinin__InfluenzaA__ALE31836

SEQ ID NO: 74359 - RNA, 1701 nt, Artificial Sequence
  derived and/or modified sequence opt1 from hemagglutinin__InfluenzaA__ALE31837
augaagaccaucaucgcccugagcuacauccucugccugguguacgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74360 - RNA, 1701 nt, Artificial Sequence; identical to SEQ ID NO: 73449
  derived and/or modified sequence opt1 from hemagglutinin__InfluenzaA__ALE31838

SEQ ID NO: 74361 - RNA, 1701 nt, Artificial Sequence; identical to SEQ ID NO: 73449
  derived and/or modified sequence opt1 from hemagglutinin__InfluenzaA__ALE31839

SEQ ID NO: 74362 - RNA, 1701 nt, Artificial Sequence
  derived and/or modified sequence opt1 from hemagglutinin__InfluenzaA__ALE31840
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgccugcggauccgcgacauccccucccggaucagcaucuacuggaccaucgucaagcccggcgacauccugcucaucaacuccaccgggaaccugaucgcgccccgcggcuacuucaagauccggagcgggaaguccagcaucaugcgcuccgacgccccgaucggcaagugcaagagcgagugcaucacccccaacggcuccauccccaacgacaagcccuuccagaacgugaaccggaucacguacggggccugcccgcgcuacgugaagcacagcacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 74363 - RNA, 1701 nt, Artificial Sequence; identical to SEQ ID NO: 73449
  derived and/or modified sequence opt1 from hemagglutinin__InfluenzaA__ALE31842

SEQ ID NO: 74364 - RNA, 1701 nt, Artificial Sequence
  derived and/or modified sequence opt1 from hemagglutinin__InfluenzaA__ALE31843
augcagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcggaucaccgugagcacgaagcgcucccagcaggccgugaucccgaacaucggcagccggccccgcauccgggacauccccucccgcaucagcaucuacuggaccaucgucaagcccggcgacauccugcugaucaacuccaccgggaaccucaucgccccgcggggcuacuucaagauccugagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 74365 - RNA, 1701 nt, Artificial Sequence; identical to SEQ ID NO: 74006
  derived and/or modified sequence opt1 from hemagglutinin__InfluenzaA__ALE31844

SEQ ID NO: 74366 - RNA, 1701 nt, Artificial Sequence; identical to SEQ ID NO: 73982
  derived and/or modified sequence opt1 from hemagglutinin__InfluenzaA__ALE31846

SEQ ID NO: 74367 - RNA, 1701 nt, Artificial Sequence; identical to SEQ ID NO: 73449
  derived and/or modified sequence opt1 from hemagglutinin__InfluenzaA__ALE31847

SEQ ID NO: 74368 - RNA, 1701 nt, Artificial Sequence; identical to SEQ ID NO: 73449
  derived and/or modified sequence opt1 from hemagglutinin__InfluenzaA__ALE31848

SEQ ID NO: 74369 - RNA, 1701 nt, Artificial Sequence
  derived and/or modified sequence opt1 from hemagglutinin__InfluenzaA__ALE31850
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgagcggccggaucaccgugagcaccaagcgcucccagcaggccgugauccccaacaucggcagccggccccgcauccgggacauccccucccgcaucagcaucuacuggaccaucgucaagccgggggacauccugcucaucaacuccacgggcaaccugaucgcgccccggggguacuucaagauccgcagcggcaaguccagcaucaugcgguccgacgcccccaucggcaagugcaagagcgagugcaucacccccaacggguccaucccgaacgacaagcccuuccagaacgugaaccgcgugaccuacggcgccugcccccgguacgucaagcagagcacccugaagcucgccacggggaugcgcaacgugcccgagcggcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacgucuaccgcgacgaggcccucaacaaccgguuccagaucaagggcguggagcugaaguccggcuacaaggacuggauccuguggaucagcuucgccaucagcugcuuccuccugugcguggcccugcucggguucaucaugugggccugccagaagggcaacauccgcugcaacaucugcaucuga

SEQ ID NO: 74370 - RNA, 1701 nt, Artificial Sequence
  derived and/or modified sequence opt1 from hemagglutinin__InfluenzaA__ALE31851
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaucgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74371 - RNA, 1701 nt, Artificial Sequence; identical to SEQ ID NO: 73993
  derived and/or modified sequence opt1 from hemagglutinin__InfluenzaA__ALE31852

SEQ ID NO: 74372 - RNA, 1701 nt, Artificial Sequence
  derived and/or modified sequence opt1 from hemagglutinin__InfluenzaA__ALE31853
augaagaccaucaucgcccugagcuacauccucugccugguguucacccagaagauccccggcaacgacaacuccacggccacccugugccucgggcaccacgcggucccgaacggcaccaucgugaagaccaucacgaacgaccgcaucgaggugaccaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgccucccugcgcagccuggucgcguccagcggcacgcucgaguucaacaacgaguccuucaacuggaccggggugacccagaacggcaccagcuccgccugcauccggcgcagcuccagcuccuucuucagccggcugaacuggcugacgcaccucaacuacaccuaccccgcccugaacgugaccaugcccaacaacgagcaguucgacaagcuguacaucuggggcguccaccaccccgggaccgacaaggaccagaucuuccucuacgcccaguccagcgggcgcaucacggugagcaccaagcggucccagcaggcggugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacgcccaacggcuccauccccaacgacaagccguuccagaacgugaaccggaucaccuacggggccugcccccgcuacgugaagcacagcacccugaagcuggccaccggcaugcggaacguccccgagaagcagacgcgcgggaucuucggcgcgaucgccggguucaucgagaacggcugggagggcaugguggacgggugguacggcuuccggcaccagaacuccgaggggcgcggccaggccgccgaccucaagagcacccaggccgcgaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgccugcaucgggagcauccggaacggcaccuacgaccacaacguguaccgcgacgaggcgcugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74373 - RNA, 1701 nt, Artificial Sequence
  derived and/or modified sequence opt1 from hemagglutinin__InfluenzaA__ALE31854
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgcuccagcgggcggaucaccgugagcacgaagggcucccagcaggccgugaucccgaacaucggcagccgcccccggauccgcgacauccccucccggaucagcaucuacuggaccaucgucaagcccggggacauccugcugaucaacuccaccggcaaccucaucgccccgcgcggguacuucaagauccggagcggcaaguccagcaucaugcgcuccgacgcccccaucggccggugcaagagcgagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgggagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 74374 - RNA, 1701 nt, Artificial Sequence; identical to SEQ ID NO: 74135
  derived and/or modified sequence opt1 from hemagglutinin__InfluenzaA__ALE31855

SEQ ID NO: 74375 - RNA, 1701 nt, Artificial Sequence; identical to SEQ ID NO: 73449
  derived and/or modified sequence opt1 from hemagglutinin__InfluenzaA__ALE31856

SEQ ID NO: 74376 - RNA, 1701 nt, Artificial Sequence; identical to SEQ ID NO: 73449
  derived and/or modified sequence opt1 from hemagglutinin__InfluenzaA__ALE31857

SEQ ID NO: 74377 - RNA, 1701 nt, Artificial Sequence
  derived and/or modified sequence opt1 from hemagglutinin__InfluenzaA__ALE31858
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74378 - RNA, 1701 nt, Artificial Sequence
  derived and/or modified sequence opt1 from hemagglutinin__InfluenzaA__ALE31859
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcacccggcgcagcuccagcuccuucuucagccggcugaacuggcugacgcaccucaacuacaccuaccccgcccugaacgugaccaugcccaacaacgagcaguucgacaagcuguacaucuggggcguccaccaccccgggaccgacaaggaccagaucuuccucuacgcgcaguccagcgggcgcaucacggugagcaccaagcggucccagcaggccgugaucccgaacaucggcagccgcccccggauccgcgacauccccucccggaucagcaucuacuggaccaucgucaagcccggcgacaugcugcugaucaacuccaccgggaaccucaucgccccgcgcggcuacuucaagauccggagcgggaaguccagcaucaugcgcuccgacgcccccaucggcaagugcaagagcgagugcaucacgcccaacggcuccauccccaacgacaagccguuccagaacgugaaccggaucaccuacggggccugcccccgcuacgugaagcacagcacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74379 - RNA, 1701 nt, Artificial Sequence
  derived and/or modified sequence opt1 from hemagglutinin__InfluenzaA__ALE31860
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucgggaagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcggggaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74380 - RNA, 1701 nt, Artificial Sequence; identical to SEQ ID NO: 73449
  derived and/or modified sequence opt1 from hemagglutinin__InfluenzaA__ALE31861

SEQ ID NO: 74381 - RNA, 1701 nt, Artificial Sequence
  derived and/or modified sequence opt1 from hemagglutinin__InfluenzaA__ALE31862
augaagaugaucaucgcccugagcuacauccucugccugguguucgcccagaagauccccggcaacgacaacuccaccgcgacccugugccucgggcaccacgccgucccgaacggcacgaucgugaagaccaucaccaacgaccgcaucgaggugaccaacgccacggagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggaccggggugacgcagaacggcaccagcuccgccugcauccgcaagagcuccagcuccuucuucagccggcugaacuggcugacccaccucaacuacaccuaccccgcccugaacgugacgaugcccaacaacgagcaguucgacaagcuguacaucuggggcguccaccaccccgggaccgacaaggaccagaucuuccucuacgcgcgguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgaguuccugguggcccucgagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 74382 - RNA, 1701 nt, Artificial Sequence; identical to SEQ ID NO: 74107
  derived and/or modified sequence opt1 from hemagglutinin__InfluenzaA__ALE31863

SEQ ID NO: 74383 - RNA, 1701 nt, Artificial Sequence; identical to SEQ ID NO: 74107
  derived and/or modified sequence opt1 from hemagglutinin__InfluenzaA__ALE31865

SEQ ID NO: 74384 - RNA, 1701 nt, Artificial Sequence; identical to SEQ ID NO: 74107
  derived and/or modified sequence opt1 from hemagglutinin__InfluenzaA__ALE31866

SEQ ID NO: 74385 - RNA, 1701 nt, Artificial Sequence
  derived and/or modified sequence opt1 from hemagglutinin__InfluenzaA__ALE31867
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaacgggaacauccgcugcaacaucugcaucuga

SEQ ID NO: 74386 - RNA, 1701 nt, Artificial Sequence; identical to SEQ ID NO: 73449
  derived and/or modified sequence opt1 from hemagglutinin__InfluenzaA__ALE31868

SEQ ID NO: 74387 - RNA, 1701 nt, Artificial Sequence; identical to SEQ ID NO: 74385
  derived and/or modified sequence opt1 from hemagglutinin__InfluenzaA__ALE31869

SEQ ID NO: 74388 - RNA, 1701 nt, Artificial Sequence; identical to SEQ ID NO: 74385
  derived and/or modified sequence opt1 from hemagglutinin__InfluenzaA__ALE31870

SEQ ID NO: 74389 - RNA, 1701 nt, Artificial Sequence
  derived and/or modified sequence opt1 from hemagglutinin__InfluenzaA__ALE31871
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcaacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74390 - RNA, 1701 nt, Artificial Sequence; identical to SEQ ID NO: 73435
  derived and/or modified sequence opt1 from hemagglutinin__InfluenzaA__ALE31872

SEQ ID NO: 74391 - RNA, 1701 nt, Artificial Sequence; identical to SEQ ID NO: 73449
  derived and/or modified sequence opt1 from hemagglutinin__InfluenzaA__ALE31873

SEQ ID NO: 74392 - RNA, 1701 nt, Artificial Sequence
  derived and/or modified sequence opt1 from hemagglutinin__InfluenzaA__ALE31874
augaagaccaucaucgcccugagcuacauccucugccugguguucgcccagaagcugcccggcaacgacaacuccgcggccacccucugccuggggcaccacgccgucccgaacggcacgaucgugaagaccaucaccaacgaccgcaucgaggugaccaacgccacggagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggcgcacagcaacugcuaccccuacgacgugccggacuacgccucccugcgcagccucgucgccuccagcggcacccuggaguucaacaacgaguccuucaacugggccggggugacccagaacggcacgagcuccagcugcauccggggguccaacagcuccuucuucagccgccugaacuggcucacccaccugaacuccaaguaccccgcgcugaacgugaccaugcccaacaacgagcaguucgacaagcucuacaucuggggcguccaccaccccgggaccgacaaggaccagaucuuccuguacgcccagagcagcggccggaucacgguguccaccaagcgcagccagcaggccgugaucccgaacaucggcucccggccccgcauccgggacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaaguccgagugcaucacgcccaacgggagcauccccaacgacaagccguuccagaacgugaaccgcaucaccuacggcgcgugcccccgguacgugaagcaguccacccugaagcucgccaccgggaugcgcaacguccccgagaagcagacgcggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagagcggcuacaaggacuggauccuguggaucagcuucgccaucuccugcuuccugcugugcguggcccugcucggguucaucaugugggcgugccagaagggcaacauccggugcaacaucugcaucuga

SEQ ID NO: 74393 - RNA, 1701 nt, Artificial Sequence; identical to SEQ ID NO: 74392
  derived and/or modified sequence opt1 from hemagglutinin__InfluenzaA__ALE31875

SEQ ID NO: 74394 - RNA, 1701 nt, Artificial Sequence; identical to SEQ ID NO: 74392
  derived and/or modified sequence opt1 from hemagglutinin__InfluenzaA__ALE31876

SEQ ID NO: 74395 - RNA, 1701 nt, Artificial Sequence
  derived and/or modified sequence opt1 from hemagglutinin__InfluenzaA__ALE31877
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacagcgagaucaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 74396 - RNA, 1701 nt, Artificial Sequence; identical to SEQ ID NO: 73449
  derived and/or modified sequence opt1 from hemagglutinin__InfluenzaA__ALE31878

SEQ ID NO: 74397 - RNA, 1701 nt, Artificial Sequence; identical to SEQ ID NO: 73449
  derived and/or modified sequence opt1 from hemagglutinin__InfluenzaA__ALE31879

SEQ ID NO: 74398 - RNA, 1701 nt, Artificial Sequence; identical to SEQ ID NO: 73449
  derived and/or modified sequence opt1 from hemagglutinin__InfluenzaA__ALE31880

SEQ ID NO: 74399 - RNA, 1701 nt, Artificial Sequence
  derived and/or modified sequence opt1 from hemagglutinin__InfluenzaA__ALE31881
augaagaccaucaucgcccugagccacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucguggccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaacaaccgguuccagaucaaggggaucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74400 - RNA, 1701 nt, Artificial Sequence; identical to SEQ ID NO: 73449
  derived and/or modified sequence opt1 from hemagglutinin__InfluenzaA__ALE31882

SEQ ID NO: 74401 - RNA, 1701 nt, Artificial Sequence; identical to SEQ ID NO: 73449
  derived and/or modified sequence opt1 from hemagglutinin__InfluenzaA__ALE31888

SEQ ID NO: 74402 - RNA, 1701 nt, Artificial Sequence; identical to SEQ ID NO: 73449
  derived and/or modified sequence opt1 from hemagglutinin__InfluenzaA__ALE31889

SEQ ID NO: 74403 - RNA, 1701 nt, Artificial Sequence; identical to SEQ ID NO: 74107
  derived and/or modified sequence opt1 from hemagglutinin__InfluenzaA__ALE31890

SEQ ID NO: 74404 - RNA, 1701 nt, Artificial Sequence; identical to SEQ ID NO: 74107
  derived and/or modified sequence opt1 from hemagglutinin__InfluenzaA__ALE31891

SEQ ID NO: 74405 - RNA, 1701 nt, Artificial Sequence; identical to SEQ ID NO: 73449
  derived and/or modified sequence opt1 from hemagglutinin__InfluenzaA__ALE31892

SEQ ID NO: 74406 - RNA, 1701 nt, Artificial Sequence; identical to SEQ ID NO: 73449
  derived and/or modified sequence opt1 from hemagglutinin__InfluenzaA__ALE31893

SEQ ID NO: 74407 - RNA, 1701 nt, Artificial Sequence; identical to SEQ ID NO: 74055
  derived and/or modified sequence opt1 from hemagglutinin__InfluenzaA__ALE31894

SEQ ID NO: 74408 - RNA, 1701 nt, Artificial Sequence; identical to SEQ ID NO: 73435
  derived and/or modified sequence opt1 from hemagglutinin__InfluenzaA__ALE31895

SEQ ID NO: 74409 - RNA, 1701 nt, Artificial Sequence; identical to SEQ ID NO: 73449
  derived and/or modified sequence opt1 from hemagglutinin__InfluenzaA__ALE31896

SEQ ID NO: 74410 - RNA, 1701 nt, Artificial Sequence; identical to SEQ ID NO: 73449
  derived and/or modified sequence opt1 from hemagglutinin__InfluenzaA__ALE31897

SEQ ID NO: 74411 - RNA, 1701 nt, Artificial Sequence; identical to SEQ ID NO: 73449
  derived and/or modified sequence opt1 from hemagglutinin__InfluenzaA__ALE31898

SEQ ID NO: 74412 - RNA, 1701 nt, Artificial Sequence
  derived and/or modified sequence opt1 from hemagglutinin__InfluenzaA__ALE31899
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaugaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74413 - RNA, 1701 nt, Artificial Sequence; identical to SEQ ID NO: 74055
  derived and/or modified sequence opt1 from hemagglutinin__InfluenzaA__ALE31901

SEQ ID NO: 74414 - RNA, 1701 nt, Artificial Sequence
  derived and/or modified sequence opt1 from hemagglutinin__InfluenzaA__ALE31902
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74415 - RNA, 1701 nt, Artificial Sequence; identical to SEQ ID NO: 73449
  derived and/or modified sequence opt1 from hemagglutinin__InfluenzaA__ALE31903

SEQ ID NO: 74416 - RNA, 1701 nt, Artificial Sequence; identical to SEQ ID NO: 73449
  derived and/or modified sequence opt1 from hemagglutinin__InfluenzaA__ALE31904

SEQ ID NO: 74417 - RNA, 1701 nt, Artificial Sequence
  derived and/or modified sequence opt1 from hemagglutinin__InfluenzaA__ALE31905
augaagaccaucaucgcccugggcuacauccucugccugggguucgcccagaagauccccggcaacgacaacagcaccgcgacgcugugccucgggcaccacgccgugccgaacggcaccaucgucaagaccaucaccaacgaccgcaucgaggugacgaacgccaccgagcuggugcagaacuccagcaucggggagaucugcgacagcccccacaagauccuggacggcgagaacugcacccucaucgacgcccugcugggcgacccccagugcgacggguuccagaacaagaagugggaccucuucgucgagcgguccaaggccuacuccaacugcuaccccuacgacgugccggacuacgcgagccugcgcucccugguggccagcuccggcacccucgaguucaacaacgagagcuucaacuggacgggggucacccagaacggcaccuccagcgccugcauccggcgcuccagcuccagcuucuucucccggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcagagcuccggccgcaucaccgucagcacgaagcggagccagcaggccgugaucccgaacaucgggucccgcccccggauccgcgacauccccagccggaucuccaucuacuggaccaucgugaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgucaaccggaucacguacggggccugcccccgcuacgugaagcacuccacccugaagcuggcgaccggcaugcggaacgugcccgagaagcagacccgcgggaucuucggcgccaucgccggcuucaucgagaacgggugggagggcauggucgacgggugguacggcuuccggcaccagaacagcgaggggcgcggccaggccgccgaccucaaguccacgcaggcggccaucgaccagaucaacggcaagcugaaccggcugaucgggaagaccaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggcguggagcucaagagcggguacaaggacuggauccuguggaucuccuucgccaucagcugcuuccugcucugcgucgcccugcugggcuucaucaugugggccugccagaaggggaacauccgcugcaacaucugcaucuga

SEQ ID NO: 74418 - RNA, 1701 nt, Artificial Sequence; identical to SEQ ID NO: 73449
  derived and/or modified sequence opt1 from hemagglutinin__InfluenzaA__ALE31906

SEQ ID NO: 74419 - RNA, 1701 nt, Artificial Sequence
  derived and/or modified sequence opt1 from hemagglutinin__InfluenzaA__ALE31907
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccagcgggcgcaucaccgugagcaccaagcggucccagcaggccgugaucccgaacaucggcagccgcccccggauccgcgacauccccucccggaucagcaucuacuggacgaucgucaaguccggcgacauccugcugaucaacagcaccgggaaccucaucgcgccccgcggcuacuucaagauccgguccggcaagagcuccaucaugcgcagcgacgccccgaucgggaagugcaaguccgagugcaucacccccaacggcagcauccccaacgacaagcccuuccagaacgugaaccggaucaccuacggggccugcccgcgcuacgugaagcacuccacgcugaagcuggccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74420 - RNA, 1701 nt, Artificial Sequence; identical to SEQ ID NO: 73449
  derived and/or modified sequence opt1 from hemagglutinin__InfluenzaA__ALE31908

SEQ ID NO: 74421 - RNA, 1701 nt, Artificial Sequence
  derived and/or modified sequence opt1 from hemagglutinin__InfluenzaA__ALE31909
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaaguccggcgacauccugcugaucaacagcaccgggaaccucaucgcgccccgcggcuacuucaagauccgguccggcaagagcuccaucaugcgcagcgacgccccgaucgggaagugcaaguccgagugcaucacccccaacggcagcauccccaacgacaagcccuuccagaacgugaaccggaucacguacggggccugcccgcgcuacgugaagcacuccacccugaagcuggccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74422 - RNA, 1701 nt, Artificial Sequence; identical to SEQ ID NO: 73449
  derived and/or modified sequence opt1 from hemagglutinin__InfluenzaA__ALE31910

SEQ ID NO: 74423 - RNA, 1701 nt, Artificial Sequence; identical to SEQ ID NO: 74372
  derived and/or modified sequence opt1 from hemagglutinin__InfluenzaA__ALE31912

SEQ ID NO: 74424 - RNA, 1701 nt, Artificial Sequence
  derived and/or modified sequence opt1 from hemagglutinin__InfluenzaA__ALE31913
augaagaccaucaucgcccugggcuacauccucugccugguguucgcccagaagauccccgggaacgacaacagcaccgcgacgcugugccucggccaccacgccgucccgaacgggaccaucgugaagaccaucaccaacgaccgcaucgaggugacgaacgccaccgagcugguccagaacuccagcaucggcgagaucugcgacagcccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccagcuccgggacccucgaguucaacaacgagagcuucaacuggacgggcgugacccagaacgggaccuccagcgccugcauccggcgcuccagcuccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugagcacgaagcggagccagcaggccgugaucccgaacaucggcucccgcccccggauccgcgacauccccagccggaucuccaucuacuggaccaucgucaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucgaguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 74425 - RNA, 1701 nt, Artificial Sequence; identical to SEQ ID NO: 73449
  derived and/or modified sequence opt1 from hemagglutinin__InfluenzaA__ALE31914

SEQ ID NO: 74426 - RNA, 1701 nt, Artificial Sequence
  derived and/or modified sequence opt1 from hemagglutinin__InfluenzaA__ALE31915
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggaguacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74427 - RNA, 1701 nt, Artificial Sequence; identical to SEQ ID NO: 73449
  derived and/or modified sequence opt1 from hemagglutinin__InfluenzaA__ALE31916

SEQ ID NO: 74428 - RNA, 1701 nt, Artificial Sequence; identical to SEQ ID NO: 73449
  derived and/or modified sequence opt1 from hemagglutinin__InfluenzaA__ALE31917

SEQ ID NO: 74429 - RNA, 1701 nt, Artificial Sequence; identical to SEQ ID NO: 73982
  derived and/or modified sequence opt1 from hemagglutinin__InfluenzaA__ALE31918

SEQ ID NO: 74430 - RNA, 1701 nt, Artificial Sequence; identical to SEQ ID NO: 74107
  derived and/or modified sequence opt1 from hemagglutinin__InfluenzaA__ALE31920

SEQ ID NO: 74431 - RNA, 1701 nt, Artificial Sequence; identical to SEQ ID NO: 73449
  derived and/or modified sequence opt1 from hemagglutinin__InfluenzaA__ALE31921

SEQ ID NO: 74432 - RNA, 1701 nt, Artificial Sequence; identical to SEQ ID NO: 73449
  derived and/or modified sequence opt1 from hemagglutinin__InfluenzaA__ALE31922

SEQ ID NO: 74433 - RNA, 1701 nt, Artificial Sequence; identical to SEQ ID NO: 73993
  derived and/or modified sequence opt1 from hemagglutinin__InfluenzaA__ALE31923

SEQ ID NO: 74434 - RNA, 1701 nt, Artificial Sequence; identical to SEQ ID NO: 73449
  derived and/or modified sequence opt1 from hemagglutinin__InfluenzaA__ALE31924

SEQ ID NO: 74435 - RNA, 1701 nt, Artificial Sequence; identical to SEQ ID NO: 73449
  derived and/or modified sequence opt1 from hemagglutinin__InfluenzaA__ALE31925

SEQ ID NO: 74436 - RNA, 1701 nt, Artificial Sequence
  derived and/or modified sequence opt1 from hemagglutinin__InfluenzaA__ALE31926
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgagggguucaacuggacgggcgugacccagaacgggaccuccagcgccugcauccggcgcuccagcuccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcagagcuccggccgcaucaccgugagcaccaagcggagccagcaggccgugaucccgaacaucggcucccgcccccggauccgcgacauccccagccggaucuccaucuacuggacgaucgucaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgccugcccccgcuacgugaagcacuccacgcugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacccaggcggccaucgaccagaucaacggcaagcugaaccggcugaucggcaagacgaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 74437 - RNA, 1701 nt, Artificial Sequence; identical to SEQ ID NO: 73449
  derived and/or modified sequence opt1 from hemagglutinin__InfluenzaA__ALE31927

SEQ ID NO: 74438 - RNA, 1701 nt, Artificial Sequence
  derived and/or modified sequence opt1 from hemagglutinin__InfluenzaA__ALE31928
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccagcggccggaucaccgugagcaccaagcgcucccagcaggccgugaucccgaacaucggcagccggccccgcauccgggacauccccucccgcaucagcaucuacuggaccaucgucaagcccggggacauccugcugaucaacuccacgggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccucgagaaguacgucgaggacacgaagaucgaccuguggagcuacaacgccgagcugcucguggcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggcgugccagaagggcaacauccggugcaacaucugcaucuga

SEQ ID NO: 74439 - RNA, 1701 nt, Artificial Sequence; identical to SEQ ID NO: 74085
  derived and/or modified sequence opt1 from hemagglutinin__InfluenzaA__ALE31930

SEQ ID NO: 74440 - RNA, 1701 nt, Artificial Sequence; identical to SEQ ID NO: 73449
  derived and/or modified sequence opt1 from hemagglutinin__InfluenzaA__ALE31931

SEQ ID NO: 74441 - RNA, 1701 nt, Artificial Sequence; identical to SEQ ID NO: 73449
  derived and/or modified sequence opt1 from hemagglutinin__InfluenzaA__ALE31932

SEQ ID NO: 74442 - RNA, 1701 nt, Artificial Sequence
  derived and/or modified sequence opt1 from hemagglutinin__InfluenzaA__ALE31933
augaagaccaucaucgcccugagcuacauccucugccugguguacgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74443 - RNA, 1701 nt, Artificial Sequence
  derived and/or modified sequence opt1 from hemagglutinin__InfluenzaA__ALE31934
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccaggcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugauccccaacaucggcagccgcccgcggauccgcgacauccccucccggaucagcaucuacuggaccaucgucaagcccggcgacauccugcugaucaacuccaccgggaaccucaucgcgccccgcggcuacuucaagauccggagcgggaaguccagcaucaugcgcuccgacgccccgaucggcaagugcaagagcgagugcaucacccccaacggcuccauccccaacgacaagcccuuccagaacgugaaccggaucacguacggggccugcccgcgcuacgugaagcacagcacccugaagcuggccaccggcaugcggaacauccccgagaagcagacccgcgggaucuucggcgccaucgccggguucaucgagaacggcugggagggcauggucgacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 74444 - RNA, 1701 nt, Artificial Sequence; identical to SEQ ID NO: 73449
  derived and/or modified sequence opt1 from hemagglutinin__InfluenzaA__ALE31935

SEQ ID NO: 74445 - RNA, 1701 nt, Artificial Sequence; identical to SEQ ID NO: 74231
  derived and/or modified sequence opt1 from hemagglutinin__InfluenzaA__ALE31936

SEQ ID NO: 74446 - RNA, 1701 nt, Artificial Sequence
  derived and/or modified sequence opt1 from hemagglutinin__InfluenzaA__ALE31937
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccgcaucgaggugacgaacgccaccgagcugguccagaacagcuccaucggcgagaucugcgacagcccccaccagauccucgacggggagaacugcacccugaucgacgcccugcucggcgacccccagugcgacggguuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggcgugacgcagaacgggaccagcuccagcugcauccggggcuccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgagcgggcggaucaccgugagcaccaagcgcucccagcaggccgugauccccaacaucggcagccggccccgcauccgggacauccccucccgcaucagcaucuacuggaccaucgucaagccgggcgacauccugcucaucaacuccacggggaaccugaucgcgccccggggcuacuucaagauccgcagcgggaaguccagcaucaugcgguccgacgcccccaucggcaagugcaagagcgagugcaucacccccaacggcuccaucccgaacgacaagcccuuccagaacgugaaccgcaucaccuacggggccugcccccgguacgugaagcagagcacccugaagcucgccacgggcaugcgcaacguccccgagcggcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcacguacgaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 74447 - RNA, 1701 nt, Artificial Sequence; identical to SEQ ID NO: 73449
  derived and/or modified sequence opt1 from hemagglutinin__InfluenzaA__ALE31938

SEQ ID NO: 74448 - RNA, 1701 nt, Artificial Sequence; identical to SEQ ID NO: 74055
  derived and/or modified sequence opt1 from hemagglutinin__InfluenzaA__ALE31939

SEQ ID NO: 74449 - RNA, 1701 nt, Artificial Sequence; identical to SEQ ID NO: 73449
  derived and/or modified sequence opt1 from hemagglutinin__InfluenzaA__ALE31941

SEQ ID NO: 74450 - RNA, 1701 nt, Artificial Sequence; identical to SEQ ID NO: 74006
  derived and/or modified sequence opt1 from hemagglutinin__InfluenzaA__ALE31943

SEQ ID NO: 74451 - RNA, 1701 nt, Artificial Sequence
  derived and/or modified sequence opt1 from hemagglutinin__InfluenzaA__ALE31944
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccgggacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 74452 - RNA, 1701 nt, Artificial Sequence
  derived and/or modified sequence opt1 from hemagglutinin__InfluenzaA__ALE31945
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagggcucccagcaggccgugaucccgaacgucggcagccggccccgcauccgggacauccccucccgcaucagcaucuacuggaccaucgugaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucacguacggcgccugcccccgguacgucaagcacagcacccugaagcuggcgaccgggaugcgcaacgugcccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgaggucgaggggcggauccaggacaucgagaaguacguggaggacaccaagaucgaccucuggagcuacaacgccgagcugcugguggcccucgagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacgucuaccgggacgaggcccugaacaaccgcuuccagaucaagggcguggagcugaaguccggcuacaaggacuggauccucuggaucagcuucgccaucagcugcuuccugcugugcguggcccuccugggguucaucaugugggccugccagaagggcaacauccggugcaacaucugcaucuga

SEQ ID NO: 74453 - RNA, 1701 nt, Artificial Sequence; identical to SEQ ID NO: 74107
  derived and/or modified sequence opt1 from hemagglutinin__InfluenzaA__ALE31946

SEQ ID NO: 74454 - RNA, 1701 nt, Artificial Sequence; identical to SEQ ID NO: 74107
  derived and/or modified sequence opt1 from hemagglutinin__InfluenzaA__ALE31947

SEQ ID NO: 74455 - RNA, 1701 nt, Artificial Sequence
  derived and/or modified sequence opt1 from hemagglutinin__InfluenzaA__ALE31948
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcuggugggcaagaccaacgagaaguuccaccagaucgagaaggaguucuccgaggucgagggccgcauccaggaccucgagaaguacguggaggacaccaagaucgaccuguggagcuacaacgccgaguuccugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaacaaccgguuccagaucaaggggguggagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 74456 - RNA, 1701 nt, Artificial Sequence; identical to SEQ ID NO: 74107
  derived and/or modified sequence opt1 from hemagglutinin__InfluenzaA__ALE31949

SEQ ID NO: 74457 - RNA, 1701 nt, Artificial Sequence; identical to SEQ ID NO: 73449
  derived and/or modified sequence opt1 from hemagglutinin__InfluenzaA__ALE31950

SEQ ID NO: 74458 - RNA, 1701 nt, Artificial Sequence; identical to SEQ ID NO: 73993
  derived and/or modified sequence opt1 from hemagglutinin__InfluenzaA__ALE31951

SEQ ID NO: 74459 - RNA, 1701 nt, Artificial Sequence; identical to SEQ ID NO: 73449
  derived and/or modified sequence opt1 from hemagglutinin__InfluenzaA__ALE31952

SEQ ID NO: 74460 - RNA, 1701 nt, Artificial Sequence
  derived and/or modified sequence opt1 from hemagglutinin__InfluenzaA__ALE31953
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuucgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74461 - RNA, 1701 nt, Artificial Sequence
  derived and/or modified sequence opt1 from hemagglutinin__InfluenzaA__ALE31954
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcaagaacugcacccugaucgacgcccugcucggggacccccagugcgacggcuuccagaacaagcggugggaccuguucguggagcgcuccaaggccuacagcaacugcuaccccuacgacgugccggacuacgcgucccugcggagccucgucgccuccagcggcacccuggaguucaacgacgaguccuucaacugggccggggugacgcagaacggcaccagcuccgccugcauccgcgggagcaacuccagcuucuucucccggcugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccacuccagcggccgcaucaccgugagcaccaagcggucccagcaggccgugaucccgaacgucggcagccgcccccggauccgcaacauccccucccggaucagcaucuacuggaccaucgugaagcccggggacauccugcugaucaacuccacgggcaaccucaucgccccgcgcggguacuucaagauccagagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgucaagcagagcacccugaagcuggccacggggaugcgcaacgugcccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccuggugggcaagaccaacgagaaguuccaccagaucgagaaggaguucuccgaggucgaggggcggauccaggaccucgagaaguacguggaggacacgaagaucgaccuguggagcuacaacgccgagcugcucguggcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacuacgucuaccgggacgaggcccugaacaaccgcuuccagaucaagggcguggagcucaaguccggcuacaaggacuggauccuguggaucagcuucgccaucagcugcuuccugcucugcguggcccugcugggguucaucaugugggcgugccagaagggcaacauccggugcaacaucugcaucuga

SEQ ID NO: 74462 - RNA, 1701 nt, Artificial Sequence; identical to SEQ ID NO: 73449
  derived and/or modified sequence opt1 from hemagglutinin__InfluenzaA__ALE31955

SEQ ID NO: 74463 - RNA, 1701 nt, Artificial Sequence
  derived and/or modified sequence opt1 from hemagglutinin__InfluenzaA__ALE31956
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcaacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74464 - RNA, 1701 nt, Artificial Sequence; identical to SEQ ID NO: 74055
  derived and/or modified sequence opt1 from hemagglutinin__InfluenzaA__ALE31957

SEQ ID NO: 74465 - RNA, 1701 nt, Artificial Sequence
  derived and/or modified sequence opt1 from hemagglutinin__InfluenzaA__ALE31958
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagcaagccccgcauccgggacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74466 - RNA, 1701 nt, Artificial Sequence
  derived and/or modified sequence opt1 from hemagglutinin__InfluenzaA__ALE31959
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccgguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggcgugcccccgcuacgugaagcacagcacgcugaagcuggccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgcggaccucaagagcacccaggccgccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgcggaggacauggggaacggcugcuucaagaucuaccacaagugcgacaacgccugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggcgugccagaaggggaacauccgcugcaacaucugcaucuga

SEQ ID NO: 74467 - RNA, 1701 nt, Artificial Sequence; identical to SEQ ID NO: 73449
  derived and/or modified sequence opt1 from hemagglutinin__InfluenzaA__ALE31960

SEQ ID NO: 74468 - RNA, 1701 nt, Artificial Sequence; identical to SEQ ID NO: 73638
  derived and/or modified sequence opt1 from hemagglutinin__InfluenzaA__ALE31961

SEQ ID NO: 74469 - RNA, 1701 nt, Artificial Sequence
  derived and/or modified sequence opt1 from hemagglutinin__InfluenzaA__ALE31962
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaugagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74470 - RNA, 1701 nt, Artificial Sequence
  derived and/or modified sequence opt1 from hemagglutinin__InfluenzaA__ALE31963
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaccuuccucuacgcgcaguccagcgggcgcaucacggugagcaccaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacgcccaacggcuccauccccaacgacaagccguuccagaacgugaaccggaucaccuacggggccugcccccgcuacgugaagcacagcacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacaaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74471 - RNA, 1701 nt, Artificial Sequence
  derived and/or modified sequence opt1 from hemagglutinin__InfluenzaA__ALE31964
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacuacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccagagcgggaaguccagcaucaugcgguccgacgcccccaucggcaagugcaagagcgagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74472 - RNA, 1701 nt, Artificial Sequence; identical to SEQ ID NO: 73449
  derived and/or modified sequence opt1 from hemagglutinin__InfluenzaA__ALE31965

SEQ ID NO: 74473 - RNA, 1701 nt, Artificial Sequence; identical to SEQ ID NO: 74107
  derived and/or modified sequence opt1 from hemagglutinin__InfluenzaA__ALE31966

SEQ ID NO: 74474 - RNA, 1701 nt, Artificial Sequence; identical to SEQ ID NO: 74377
  derived and/or modified sequence opt1 from hemagglutinin__InfluenzaA__ALE31967

SEQ ID NO: 74475 - RNA, 1701 nt, Artificial Sequence; identical to SEQ ID NO: 73993
  derived and/or modified sequence opt1 from hemagglutinin__InfluenzaA__ALE31968

SEQ ID NO: 74476 - RNA, 1701 nt, Artificial Sequence; identical to SEQ ID NO: 74100
  derived and/or modified sequence opt1 from hemagglutinin__InfluenzaA__ALE31969

SEQ ID NO: 74477 - RNA, 1701 nt, Artificial Sequence; identical to SEQ ID NO: 73449
  derived and/or modified sequence opt1 from hemagglutinin__InfluenzaA__ALE31970

SEQ ID NO: 74478 - RNA, 1701 nt, Artificial Sequence
  derived and/or modified sequence opt1 from hemagglutinin__InfluenzaA__ALE31971
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccaguccagcgggcgcaucaccgugagcaccaagggcucccagcaggccgugaucccgaacaucggcagccggccccgcauccgggacauccccucccgcaucagcaucuacuggacgaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcacagcacgcugaagcuggccaccgggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagacgaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgcggaggacaugggcaacgggugcuucaagaucuaccacaagugcgacaacgccugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggcgugccagaagggcaacauccggugcaacaucugcaucuga

SEQ ID NO: 74479 - RNA, 1701 nt, Artificial Sequence; identical to SEQ ID NO: 73993
  derived and/or modified sequence opt1 from hemagglutinin__InfluenzaA__ALE31972

SEQ ID NO: 74480 - RNA, 1701 nt, Artificial Sequence; identical to SEQ ID NO: 73993
  derived and/or modified sequence opt1 from hemagglutinin__InfluenzaA__ALE31973

SEQ ID NO: 74481 - RNA, 1701 nt, Artificial Sequence; identical to SEQ ID NO: 73638
  derived and/or modified sequence opt1 from hemagglutinin__InfluenzaA__ALE31974

SEQ ID NO: 74482 - RNA, 1701 nt, Artificial Sequence; identical to SEQ ID NO: 73993
  derived and/or modified sequence opt1 from hemagglutinin__InfluenzaA__ALE31975

SEQ ID NO: 74483 - RNA, 1701 nt, Artificial Sequence; identical to SEQ ID NO: 73449
  derived and/or modified sequence opt1 from hemagglutinin__InfluenzaA__ALE31976

SEQ ID NO: 74484 - RNA, 1701 nt, Artificial Sequence; identical to SEQ ID NO: 73449
  derived and/or modified sequence opt1 from hemagglutinin__InfluenzaA__ALE31977

SEQ ID NO: 74485 - RNA, 1701 nt, Artificial Sequence
  derived and/or modified sequence opt1 from hemagglutinin__InfluenzaA__ALE31978
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugauccacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74486 - RNA, 1701 nt, Artificial Sequence; identical to SEQ ID NO: 73449
  derived and/or modified sequence opt1 from hemagglutinin__InfluenzaA__ALE31979

SEQ ID NO: 74487 - RNA, 1701 nt, Artificial Sequence
  derived and/or modified sequence opt1 from hemagglutinin__InfluenzaA__ALE31980
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccgaguacaaggacuggauccuguggaucagcuucgccaucagcugcuuccugcucugcguggcccugcugggcuucaucaugugggccugccagaagggcaacauccgcugcaacaucugcaucuga

SEQ ID NO: 74488 - RNA, 1701 nt, Artificial Sequence; identical to SEQ ID NO: 73449
  derived and/or modified sequence opt1 from hemagglutinin__InfluenzaA__ALE31981

SEQ ID NO: 74489 - RNA, 1701 nt, Artificial Sequence; identical to SEQ ID NO: 73989
  derived and/or modified sequence opt1 from hemagglutinin__InfluenzaA__ALE31995

SEQ ID NO: 74490 - RNA, 1701 nt, Artificial Sequence
  derived and/or modified sequence opt1 from hemagglutinin__InfluenzaA__ALE31996
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccgggugacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74491 - RNA, 1701 nt, Artificial Sequence
  derived and/or modified sequence opt1 from hemagglutinin__InfluenzaA__ALE31997
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucaucgagcgguccaaggccuacagcaacugcuaccccuacgacgugccggacuacgcgucccugcgcagccugguggccuccagcggcacccucgaguucaacaacgaguccuucaacuggacgggggucacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcaguccagcgggcgcaucaccgucagcacgaagcggucccagcaggccgugaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 74492 - RNA, 1701 nt, Artificial Sequence; identical to SEQ ID NO: 73449
  derived and/or modified sequence opt1 from hemagglutinin__InfluenzaA__ALE31998

SEQ ID NO: 74493 - RNA, 1701 nt, Artificial Sequence
  derived and/or modified sequence opt1 from hemagglutinin__InfluenzaA__ALE31999
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccuccacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74494 - RNA, 1701 nt, Artificial Sequence
  derived and/or modified sequence opt1 from hemagglutinin__InfluenzaA__ALE32000
augaagaccaucaucgcccugagccacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 74495 - RNA, 1701 nt, Artificial Sequence; identical to SEQ ID NO: 73449
  derived and/or modified sequence opt1 from hemagglutinin__InfluenzaA__ALE32001

SEQ ID NO: 74496 - RNA, 1701 nt, Artificial Sequence; identical to SEQ ID NO: 73449
  derived and/or modified sequence opt1 from hemagglutinin__InfluenzaA__ALE32002

SEQ ID NO: 74497 - RNA, 1701 nt, Artificial Sequence; identical to SEQ ID NO: 73549
  derived and/or modified sequence opt1 from hemagglutinin__InfluenzaA__ALE32003

SEQ ID NO: 74498 - RNA, 1701 nt, Artificial Sequence; identical to SEQ ID NO: 73449
  derived and/or modified sequence opt1 from hemagglutinin__InfluenzaA__ALE32004

SEQ ID NO: 74499 - RNA, 1701 nt, Artificial Sequence; identical to SEQ ID NO: 73449
  derived and/or modified sequence opt1 from hemagglutinin__InfluenzaA__ALE32005

SEQ ID NO: 74500 - RNA, 1701 nt, Artificial Sequence; identical to SEQ ID NO: 73993
  derived and/or modified sequence opt1 from hemagglutinin__InfluenzaA__ALE32006

SEQ ID NO: 74501 - RNA, 1701 nt, Artificial Sequence; identical to SEQ ID NO: 73449
  derived and/or modified sequence opt1 from hemagglutinin__InfluenzaA__ALE32007

SEQ ID NO: 74502 - RNA, 1701 nt, Artificial Sequence; identical to SEQ ID NO: 74000
  derived and/or modified sequence opt1 from hemagglutinin__InfluenzaA__ALE32008

SEQ ID NO: 74503 - RNA, 1701 nt, Artificial Sequence
  derived and/or modified sequence opt1 from hemagglutinin__InfluenzaA__ALE32009
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgagccugcgcucccucgucgccagcuccggcacccuggaguucaacgacgagagcuucaacugggccggcgugacgcagaacgggaccuccagcgccugcauccggggcuccaacagcuccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcagccagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggagcgacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgugcugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaagggggucgagcucaagagcggcuacaaggacuggauccuguggaucagcuucgccaucuccugcuuccugcucugcguggcccugcugggcuucaucaugugggcgugccaggaggggaacauccggugcaacaucugcaucuga

SEQ ID NO: 74504 - RNA, 1701 nt, Artificial Sequence
  derived and/or modified sequence opt1 from hemagglutinin__InfluenzaA__ALE32010
augaagaccaucaucgcccugagcuacauccucugccuggccuucgcgcagaagauccccggcaacgacaacuccaccgccacgcugugccucgggcaccacgccgugccgaacggcaccaucgucaagaccaucaccaacgaccgcaucgaggugacgaacgccaccgagcuggugcagaacagcuccaucggggagaucugcgacagcccccaccagauccuggacggcgagaacugcacccucaucgacgcccugcugggggacccccagugcgacggcuuccagaacaagaagugggaccucuucgucgagcgguccaaggcguacagcaacugcuaccccuacgacgugccggacuacgccucccugcgcagccugguggccuccagcggcacccucgaguucaacaacgaguccuucaacuggacgggggucacccagaacggcaccagcuccgccugcauccggcgcagcuccagcuccuucuucagccggcugaacuggcugacccaccuccacuacacguaccccgcgcugaacgugaccaugcccaacaacgagcaguucgacaagcuguacaucuggggcgugcaccaccccgggaccgacaaggaccagaucuuccucuacgcccaguccagcgggcgcaucaccgucagcacgaagcggucccagcaggccgugaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgucaaccggaucacguacggggcgugcccccgcuacgugaagcacagcacccugaagcuggccaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgcggaccucaagagcacgcaggccgccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggcgugccagaaggggaacauccgcugcaacaucugcaucuga

SEQ ID NO: 74505 - RNA, 1701 nt, Artificial Sequence; identical to SEQ ID NO: 74463
  derived and/or modified sequence opt1 from hemagglutinin__InfluenzaA__ALE32011

SEQ ID NO: 74506 - RNA, 1701 nt, Artificial Sequence; identical to SEQ ID NO: 74006
  derived and/or modified sequence opt1 from hemagglutinin__InfluenzaA__ALE32012

SEQ ID NO: 74507 - RNA, 1701 nt, Artificial Sequence; identical to SEQ ID NO: 73449
  derived and/or modified sequence opt1 from hemagglutinin__InfluenzaA__ALE32013

SEQ ID NO: 74508 - RNA, 1701 nt, Artificial Sequence
  derived and/or modified sequence opt1 from hemagglutinin__InfluenzaA__ALE32014
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccagcucaacuacacguaccccgcccugaacgugaccaugcccaacaacgagcaguucgacaagcuguacaucuggggcguccaccaccccgggaccgacaaggaccagaucuuccucuacgcgcaguccagcgggcggaucaccgugagcacgaagcgcucccagcaggccgugaucccgaacaucggcagccggccccgcauccgggacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74509 - RNA, 1701 nt, Artificial Sequence; identical to SEQ ID NO: 74334
  derived and/or modified sequence opt1 from hemagglutinin__InfluenzaA__ALE32015

SEQ ID NO: 74510 - RNA, 1701 nt, Artificial Sequence; identical to SEQ ID NO: 73449
  derived and/or modified sequence opt1 from hemagglutinin__InfluenzaA__ALE32016

SEQ ID NO: 74511 - RNA, 1701 nt, Artificial Sequence; identical to SEQ ID NO: 73449
  derived and/or modified sequence opt1 from hemagglutinin__InfluenzaA__ALE32017

SEQ ID NO: 74512 - RNA, 1701 nt, Artificial Sequence; identical to SEQ ID NO: 73449
  derived and/or modified sequence opt1 from hemagglutinin__InfluenzaA__ALE32018

SEQ ID NO: 74513 - RNA, 1701 nt, Artificial Sequence; identical to SEQ ID NO: 73993
  derived and/or modified sequence opt1 from hemagglutinin__InfluenzaA__ALE32020

SEQ ID NO: 74514 - RNA, 1701 nt, Artificial Sequence; identical to SEQ ID NO: 74100
  derived and/or modified sequence opt1 from hemagglutinin__InfluenzaA__ALE32021

SEQ ID NO: 74515 - RNA, 1701 nt, Artificial Sequence; identical to SEQ ID NO: 74180
  derived and/or modified sequence opt1 from hemagglutinin__InfluenzaA__ALE32022

SEQ ID NO: 74516 - RNA, 1701 nt, Artificial Sequence; identical to SEQ ID NO: 73449
  derived and/or modified sequence opt1 from hemagglutinin__InfluenzaA__ALE32023

SEQ ID NO: 74517 - RNA, 1701 nt, Artificial Sequence
  derived and/or modified sequence opt1 from hemagglutinin__InfluenzaA__ALE32024
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcaagaacugcacccugaucgacgcccugcucggggacccccagugcgacggcuuccagaacaagcggugggaccuguucguggagcgcuccaaggccuacagcaacugcuaccccuacgacgugccggacuacgcgucccugcggagccucgucgccuccagcggcacccuggaguucaacgacgaguccuucaacugggccggggugacgcagaacggcaagagcuccgccugcauccgcgggagcaacuccagcuucuucucccggcugaacuggcucacccacagcaacuucaaguaccccgcgcugaacgugaccaugcccaacaacgagcaguucgacaagcuguacaucuggggcguccaccaccccgggaccgacaaggaccagaucuuccucuacgcccacuccagcggccgcaucacggugagcaccaagcggucccagcaggccgugaucccgaacaucggcagccgcccccggauccgcaacauccccucccggaucagcaucuacuggaccaucgucaagcccggggacauccugcugaucaacuccaccggcaaccucaucgccccgcgcggguacuucaagauccagagcggcaaguccagcaucaugcgguccgacgcccccaucggcaagugcaagagcgagugcaucacgcccaacggguccauccccaacgacaagccguuccagaacgugaaccgcaucaccuacgggaccugcccccgguacgugaagcagagcacccugaagcuggcgacgggcaugcgcaacguccccgagaagcagacccggggcaucuucggggccaucgccggcuucaucgagaacggcugggaggggaugaaggacggcugguacggguuccgccaccagaacuccgagggccgggggcaggccgccgaccucaagagcacccaggcggccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgccgaggacaugggcaacgggugcuucaagaucuaccacaagugcgacaacgcgugcaucggcagcauccgcaacgggacguacgaccacuacguguaccgggacgaggcccugaacaaccgcuuccagaucaagggcguggagcucaaguccggcuacaaggacuggauccuguggaucagcuucgccaucagcugcuuccugcucugcgucgcccugcugggguucaucaugugggccugccagaagggcaacauccggugcaacaucugcaucuga

SEQ ID NO: 74518 - RNA, 1701 nt, Artificial Sequence
  derived and/or modified sequence opt1 from hemagglutinin__InfluenzaA__ALE32025
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaaguccggcgacauccugcugaucaacagcaccgggaaccucaucgcgccccgcggcuacuucaagauccgguccggcaagagcuccaucaugcgcagcgacgccccgaucgggaagugcaaguccgagugcaucacccccaacggcagcauccccaacgacaagcccuuccagaacgugaaccggaucacguacggggccugcccgcgcuacgugaagcacuccacccugaagcuggccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagauguccaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 74519 - RNA, 1701 nt, Artificial Sequence; identical to SEQ ID NO: 73449
  derived and/or modified sequence opt1 from hemagglutinin__InfluenzaA__ALE32026

SEQ ID NO: 74520 - RNA, 1701 nt, Artificial Sequence; identical to SEQ ID NO: 73993
  derived and/or modified sequence opt1 from hemagglutinin__InfluenzaA__ALE32027

SEQ ID NO: 74521 - RNA, 1701 nt, Artificial Sequence
  derived and/or modified sequence opt1 from hemagglutinin__InfluenzaA__ALE32028
augaagaccaucaucgcccugagccacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 74522 - RNA, 1701 nt, Artificial Sequence; identical to SEQ ID NO: 74100
  derived and/or modified sequence opt1 from hemagglutinin__InfluenzaA__ALE32029

SEQ ID NO: 74523 - RNA, 1701 nt, Artificial Sequence
  derived and/or modified sequence opt1 from hemagglutinin__InfluenzaA__ALE32030
augaagaccaucaucgcccugagccacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaucuaccccgcccugaacgugacgaugcccaacaacgagcaguucgacaagcuguacaucuggggcguccaccaccccgggaccgacaaggaccagaucuuccucuacgcgcaguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 74524 - RNA, 1701 nt, Artificial Sequence
  derived and/or modified sequence opt1 from hemagglutinin__InfluenzaA__ALE32031
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 74525 - RNA, 1701 nt, Artificial Sequence
  derived and/or modified sequence opt1 from hemagglutinin__InfluenzaA__ALE32032
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucgccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggcgugcccccgcuacgugaagcacagcacgcugaagcuggccaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgcggaccucaagagcacccaggccgccaucgaccagaucaacgggaagcugaaccggcugaucggcaagacgaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugaccgacuccgagaugaacaagcuguucgagaagacgaagaagcagcuccgcgagaacgcggaggacauggggaacggcugcuucaagaucuaccacaagugcgacaacgccugcaucgggagcauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggcgugccagaaggggaacauccgcugcaacaucugcaucuga

SEQ ID NO: 74526 - RNA, 1701 nt, Artificial Sequence; identical to SEQ ID NO: 73449
  derived and/or modified sequence opt1 from hemagglutinin__InfluenzaA__ALE32033

SEQ ID NO: 74527 - RNA, 1701 nt, Artificial Sequence
  derived and/or modified sequence opt1 from hemagglutinin__InfluenzaA__ALE32034
augaagaccaucaucgcccugggcuacauccucugccugguguucgcccagaagauccccgggaacgacaacagcaccgcgacgcugugccucggccaccacgccgucccgaacgggaccaucgugaagaccaucaccaacgaccgcaucgaggugacgaacgccaccgagcugguccagaacuccagcaucggcgagaucugcgacagcccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccagcuccgggacccucgaguucaacaacgagagcuucaacuggacgggcgugacccagaacgggaccuccagcgccugcauccggcgcuccagcuccagcuucuucucccggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugagcacgaagcggagccagcaggccgugaucccgaacaucggcucccgcccccggauccgcgacauccccagccggaucuccaucuacuggaccaucgucaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 74528 - RNA, 1701 nt, Artificial Sequence; identical to SEQ ID NO: 74339
  derived and/or modified sequence opt1 from hemagglutinin__InfluenzaA__ALE32035

SEQ ID NO: 74529 - RNA, 1701 nt, Artificial Sequence
  derived and/or modified sequence opt1 from hemagglutinin__InfluenzaA__ALE32036
augaagaccaucaucgcccugggcuacauccucugccugguguucgcccagaagauccccgggaacgacaacagcaccgcgacgcugugccucggccaccacgccgucccgaacgggaccaucgugaagaccaucaccaacgaccgcaucgaggugacgaacgccaccgagcugguccagaacuccagcaucggcgagaucugcgacagcccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccagcuccgggacccucgaguucaacaacgagagcuucaacuggacgggcgugacccagaacgggaccuccagcgccugcauccggcgcuccagcuccagcuucuucucccggcugaacuggcugacccaccuccacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugagcacgaagcggagccagcaggccgugaucccgaacaucggcucccgcccccggauccgcgacauccccagccggaucuccaucuacuggaccaucgucaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 74530 - RNA, 1701 nt, Artificial Sequence
  derived and/or modified sequence opt1 from hemagglutinin__InfluenzaA__ALE32037
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccugagcgggaaguccagcaucaugcgguccgacgcccccaucggcaagugcaagagcgagugcaucacccccaacggcuccauccccaacgacaagccguuccagaacgugaaccgcaucaccuacggggccugcccccgguacgugaagcacagcacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccgcaacggcaccuacgaccacaacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 74531 - RNA, 1701 nt, Artificial Sequence
  derived and/or modified sequence opt1 from hemagglutinin__InfluenzaA__ALE32038
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaaggggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccucaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 74532 - RNA, 1701 nt, Artificial Sequence; identical to SEQ ID NO: 74107
  derived and/or modified sequence opt1 from hemagglutinin__InfluenzaA__ALE32039

SEQ ID NO: 74533 - RNA, 1701 nt, Artificial Sequence
  derived and/or modified sequence opt1 from hemagglutinin__InfluenzaA__ALE32040
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaccuccagcaucaugcgcuccgacgcccccaucggcaagugcaagagcgagugcaucacgcccaacggcuccauccccaacgacaagccguuccagaacgugaaccggaucaccuacggggccugcccccgcuacgugaagcacagcacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74534 - RNA, 1701 nt, Artificial Sequence; identical to SEQ ID NO: 73449
  derived and/or modified sequence opt1 from hemagglutinin__InfluenzaA__ALE32041

SEQ ID NO: 74535 - RNA, 1701 nt, Artificial Sequence; identical to SEQ ID NO: 73449
  derived and/or modified sequence opt1 from hemagglutinin__InfluenzaA__ALE32042

SEQ ID NO: 74536 - RNA, 1701 nt, Artificial Sequence
  derived and/or modified sequence opt1 from hemagglutinin__InfluenzaA__ALE32043
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacaccucccugcgcagccuggucgcguccagcggcacgcucgaguucaacaacgaguccuucaacuggaccggggugacccagaacggcaccagcuccgccugcauccggcgcagcuccagcuccuucuucagccggcugaacuggcugacgcaccucaacuacaccuaccccgcccugaacgugaccaugcccaacaacgagcaguucgacaagcuguacaucuggggcguccaccaccccgggaccgacaaggaccagaucuuccucuacgcccaguccagcgggcgcaucacggugagcaccaagcggucccagcaggcggugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacgcccaacggcuccauccccaacgacaagccguuccagaacgugaaccggaucaccuacggggccugcccccgcuacgugaagcacagcacccugaagcuggccaccggcaugcggaacguccccgagaagcagacgcgcgggaucuucggcgcgaucgccggguucaucgagaacggcugggagggcaugguggacgggugguacggcuuccggcaccagaacuccgaggggcgcggccaggccgccgaccucaagagcacccaggccgcgaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgccugcaucgggagcauccggaacggcaccuacgaccacaacguguaccgcgacgaggcgcugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74537 - RNA, 1701 nt, Artificial Sequence; identical to SEQ ID NO: 73449
  derived and/or modified sequence opt1 from hemagglutinin__InfluenzaA__ALE32044

SEQ ID NO: 74538 - RNA, 1701 nt, Artificial Sequence; identical to SEQ ID NO: 73449
  derived and/or modified sequence opt1 from hemagglutinin__InfluenzaA__ALE32045

SEQ ID NO: 74539 - RNA, 1701 nt, Artificial Sequence; identical to SEQ ID NO: 73449
  derived and/or modified sequence opt1 from hemagglutinin__InfluenzaA__ALE32046

SEQ ID NO: 74540 - RNA, 1701 nt, Artificial Sequence
  derived and/or modified sequence opt1 from hemagglutinin__InfluenzaA__ALE32047
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccaggugcuggacggcgagaacugcacccucaucgacgcccugcugggggacccccagugcgacggcuuccagaacaagaagugggaccucuucguggagcgguccaaggccuacagcaacugcuaccccuacgacgucccggacuacgcgucccugcgcagccugguggccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgucaccaugcccaacaacgagcaguucgacaagcuguacaucuggggcgugcaccaccccgggaccgacaaggaccagaucuuccucuacgcgcaguccagcgggcgcaucaccgugagcacgaagcggucccagcaggccgucaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugaucuccgacgcccccaucggcaagugcaagagcgagugcaucacccccaacggcuccauccccagcgacaagccguuccagaacgugaaccgcaucacguacggggccugcccccgguacgucaagcacuccacccugaagcuggcgaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgccgaccucaaguccacgcaggcggccaucgaccagaucaacgggaagcugaaccgccugaucggcaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacaacgucuaccgggacgaggcccugaacaaccgcuuccagaucaaggggguggagcucaagagcggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 74541 - RNA, 1701 nt, Artificial Sequence; identical to SEQ ID NO: 73449
  derived and/or modified sequence opt1 from hemagglutinin__InfluenzaA__ALE32048

SEQ ID NO: 74542 - RNA, 1701 nt, Artificial Sequence; identical to SEQ ID NO: 74107
  derived and/or modified sequence opt1 from hemagglutinin__InfluenzaA__ALE32049

SEQ ID NO: 74543 - RNA, 1701 nt, Artificial Sequence
  derived and/or modified sequence opt1 from hemagglutinin__InfluenzaA__ALE32050
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccaggacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74544 - RNA, 1701 nt, Artificial Sequence
  derived and/or modified sequence opt1 from hemagglutinin__InfluenzaA__ALE32051
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccgggugacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaucaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74545 - RNA, 1701 nt, Artificial Sequence; identical to SEQ ID NO: 73449
  derived and/or modified sequence opt1 from hemagglutinin__InfluenzaA__ALE32052

SEQ ID NO: 74546 - RNA, 1701 nt, Artificial Sequence; identical to SEQ ID NO: 73449
  derived and/or modified sequence opt1 from hemagglutinin__InfluenzaA__ALE32053

SEQ ID NO: 74547 - RNA, 1701 nt, Artificial Sequence
  derived and/or modified sequence opt1 from hemagglutinin__InfluenzaA__ALE32054
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgagagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagggcucccagcaggccgugaucccgaacaucggcagccggccccgcauccgggacauccccucccgcaucagcaucuacuggaccaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaaccacugcaucuga

SEQ ID NO: 74548 - RNA, 1701 nt, Artificial Sequence
  derived and/or modified sequence opt1 from hemagglutinin__InfluenzaA__ALE32055
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaacgggaacauccgcugcaacaucugcaucuga

SEQ ID NO: 74549 - RNA, 1701 nt, Artificial Sequence; identical to SEQ ID NO: 74100
  derived and/or modified sequence opt1 from hemagglutinin__InfluenzaA__ALE32056

SEQ ID NO: 74550 - RNA, 1701 nt, Artificial Sequence
  derived and/or modified sequence opt1 from hemagglutinin__InfluenzaA__ALE32057
augaagaccaucaucgcccugagcuacgugcucugccuggucuucgcccagaagauccccggcaacgacaacuccaccgcgacgcugugccucgggcaccacgccgugccgaacggcaccaucgugaagaccaucaccaacgaccgcaucgaggucacgaacgccaccgagcuggugcagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgucccggacuacgcgucccugcgcagccugguggccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgucaccaugcccaacaacgagcaguucgacaagcuguacaucuggggcgugcaccaccccgggaccgacaaggaccagaucuuccucuacgcgcaguccagcgggcgcaucaccgugagcacgaagcggucccagcaggccgucaucccgaacaucggcagccgcccccggauccgcgacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74551 - RNA, 1701 nt, Artificial Sequence; identical to SEQ ID NO: 73449
  derived and/or modified sequence opt1 from hemagglutinin__InfluenzaA__ALE32058

SEQ ID NO: 74552 - RNA, 1701 nt, Artificial Sequence; identical to SEQ ID NO: 73449
  derived and/or modified sequence opt1 from hemagglutinin__InfluenzaA__ALE32059

SEQ ID NO: 74553 - RNA, 1701 nt, Artificial Sequence
  derived and/or modified sequence opt1 from hemagglutinin__InfluenzaA__ALE32060
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagguguuccucuacgcgcaguccagcgggcgcaucaccgugagcacgaagcggucccagcaggccgucaucccgaacaucggcagccgcccccggauccgcgacauccccucccggaucagcaucuacuggaccaucgugaagcccggcgacauccugcugauccacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74554 - RNA, 1701 nt, Artificial Sequence
  derived and/or modified sequence opt1 from hemagglutinin__InfluenzaA__ALE32061
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaaguacacguaccccgcccugaacgugaccaugcccaacaacgagcaguucgacaagcuguacaucuggggcguccaccaccccgggaccgacaacgaccagaucuuccucuacgcgcgcuccagcgggcggaucaccgugagcacgaagggcucccagcaggccgugaucccgaacaucggcagccgcccccggauccgcgacauccccucccggaucagcaucuacuggaccaucgucaagcccggggacauccugcugaucaacuccaccggcaaccucaucgccccgcgcggguacuucaagauccggagcggcaaguccagcaucaugcgcuccgacgcccccaucggcaagugcaagagcgagugcaucacccccaacggguccauccccaacgacaagccguuccagaacgugaaccggaucacguacggcgccugcccccgcuacgugaagcacagcacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 74555 - RNA, 1701 nt, Artificial Sequence
  derived and/or modified sequence opt1 from hemagglutinin__InfluenzaA__ALE32062
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucuacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74556 - RNA, 1701 nt, Artificial Sequence; identical to SEQ ID NO: 73449
  derived and/or modified sequence opt1 from hemagglutinin__InfluenzaA__ALE32063

SEQ ID NO: 74557 - RNA, 1701 nt, Artificial Sequence
  derived and/or modified sequence opt1 from hemagglutinin__InfluenzaA__ALE32064
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccaacagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcuccgggcgcaucaccgugagcacgaagcggagccagcaggccgugaucccgaacaucggcucccgcccccggauccgcgacauccccagccggaucuccaucuacuggaccaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaucgggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 74558 - RNA, 1701 nt, Artificial Sequence; identical to SEQ ID NO: 73449
  derived and/or modified sequence opt1 from hemagglutinin__InfluenzaA__ALE32065

SEQ ID NO: 74559 - RNA, 1701 nt, Artificial Sequence
  derived and/or modified sequence opt1 from hemagglutinin__InfluenzaA__ALE32066
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacguguccaugcccaacaacgagcaguucgacaagcuguacaucuggggcguccaccaccccgggaccgacaaggaccagaucuuccucuacgcgcagagcagcgggcgcaucaccguguccaccaagcggagccagcaggccgugaucccgaacaucggcucccgcccccggauccgcgacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcacuccacgcugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74560 - RNA, 1701 nt, Artificial Sequence; identical to SEQ ID NO: 74231
  derived and/or modified sequence opt1 from hemagglutinin__InfluenzaA__ALE32067

SEQ ID NO: 74561 - RNA, 1701 nt, Artificial Sequence; identical to SEQ ID NO: 73449
  derived and/or modified sequence opt1 from hemagglutinin__InfluenzaA__ALE32068

SEQ ID NO: 74562 - RNA, 1701 nt, Artificial Sequence; identical to SEQ ID NO: 73449
  derived and/or modified sequence opt1 from hemagglutinin__InfluenzaA__ALE32069

SEQ ID NO: 74563 - RNA, 1701 nt, Artificial Sequence
  derived and/or modified sequence opt1 from hemagglutinin__InfluenzaA__ALE32070
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggugugcccccgcuacgucaagcacagcacccugaagcuggccaccggcaugcggaacgugcccgagaagcagacccgcgggaucuucggcgcgaucgccggguucaucgagaacggcugggagggcaugguggacgggugguacggcuuccggcaccagaacuccgaggggcgcggccaggccgccgaccucaagagcacgcaggccgcgaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggagcauccggaacggcaccuacgaccacaacgucuaccgcgacgaggcgcugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74564 - RNA, 1701 nt, Artificial Sequence; identical to SEQ ID NO: 73449
  derived and/or modified sequence opt1 from hemagglutinin__InfluenzaA__ALE32071

SEQ ID NO: 74565 - RNA, 1701 nt, Artificial Sequence; identical to SEQ ID NO: 74446
  derived and/or modified sequence opt1 from hemagglutinin__InfluenzaA__ALE32072

SEQ ID NO: 74566 - RNA, 1701 nt, Artificial Sequence
  derived and/or modified sequence opt1 from hemagglutinin__InfluenzaA__ALE32073
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcggaucaccgugagcacgaagcgcucccagcaggccgugaucccgaacaucggcagccggccccgcauccgggacauccccucccgcaucagcaucuacuggaccaucgucaagcccggcgacauccugcugaucaacuccaccgggaaccucaucgccccgcggggcuacuucaagauccugagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 74567 - RNA, 1701 nt, Artificial Sequence
  derived and/or modified sequence opt1 from hemagglutinin__InfluenzaA__ALE32074
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccagcugcauccggcgcuccagcuccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcccagagcagcgggcgcaucaccguguccacgaagcggagccagcaggcggugaucccgaacaucggcucccgcccccggauccgcgacauccccagccggaucuccaucuacuggaccaucgucaagcccggcgacauccugcugaucaacagcaccgggaaccucaucgccccgcgcggcuacuucaagauccuguccggcaagagcuccaucaugcggagcgacgcccccaucgggaagugcaaguccgagugcaucacccccaacggcagcauccccaacgacaagccguuccagaacgugaaccgcaucacguacggggccugcccccgguacgugaagcacuccacccugaagcucgccaccggcaugcgcaacguccccgagaagcagacccgggggaucuucggcgcgaucgccggguucaucgagaacggcugggagggcaugguggacgggugguacggcuuccgccaccagaacagcgaggggcggggccaggccgccgaccugaaguccacgcaggccgcgaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacaacguguaccgggacgaggcgcucaacaaccgcuuccagaucaagggggucgagcucaagagcggcuacaaggacuggauccuguggaucagcuucgccaucuccugcuuccugcugugcguggcccugcucggcuucaucaugugggccugccagaaggggaacauccggugcaacaucugcaucuga

SEQ ID NO: 74568 - RNA, 1701 nt, Artificial Sequence
  derived and/or modified sequence opt1 from hemagglutinin__InfluenzaA__ALE32075
augaagaccaucaucgcccugagcuacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccagcaucggcgagaucugcgacagcccccaccagauccucgacgggaagaacugcacccugaucgacgcccugcucggcgacccccagugcgacggguuccagaacaagaagugggaccuguucguggagcgguccaaggccuacuccaacugcuaccccuacgacgugccggacuacgcgagccugcgcucccucgucgccagcuccggcacccuggaguucaacgacgagagcuucaacugggccggcgugacgcagaacgggaccuccagcuccugcauccggggcagcaacuccagcuucuucucccgccugaacuggcucacccacagcaacuucaaguaccccgcccugaacgugaccaugcccaacaacgagcaguucgacaagcuguacaucuggggcguccaccaccccgggacggacaaggaccagaucuuccucuacgcgcagagcuccgggcggaucaccgugagcaccaagcgcucccagcaggccgugaucccgaacaucggcagccggccccgcauccggaacauccccucccgcaucagcaucuacuggaccaucgucaagcccggcgacauccugcugaucaacuccacggggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucaccuacggggccugcccccgguacgugaagcagagcacccugaagcuggcgacgggcaugcgcaacguccccgagaagcagacccgggggaucuucggcgccaucgccggguucaucgagaacggcugggagggcaugaaggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgagguggagggccggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccgcaacggcacguacgaccacgacguguaccgggacgaggcccugaacaaccgcuuccagaucaaggggguggagcucaagagcggcuacaaggacuggauccuguggaucuccuucgccaucagcugcuuccugcucugcgucgcccugcugggcuucaucaugugggccugccagaaggggaacauccggugcaacaucugcaucuga

SEQ ID NO: 74569 - RNA, 1701 nt, Artificial Sequence; identical to SEQ ID NO: 74006
  derived and/or modified sequence opt1 from hemagglutinin__InfluenzaA__ALE32076

SEQ ID NO: 74570 - RNA, 1701 nt, Artificial Sequence
  derived and/or modified sequence opt1 from hemagglutinin__InfluenzaA__ALE32077
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggcccacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgcuccagcgggcggaucaccgugagcacgaagggcucccagcaggccgugaucccgaacaucggcagccgcccccggauccgcgacauccccucccggaucagcaucuacuggaccaucgucaagcccggggacauccugcugaucaacuccaccggcaaccucaucgccccgcgcggguacuucaagauccggagcggcaaguccagcaucaugcgcuccgacgcccccaucggcaagugcaagagcgagugcaucacccccaacggguccauccccaacgacaagccguuccagaacgugaaccggaucacguacggcgccugcccccgcuacgugaagcacagcacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 74571 - RNA, 1701 nt, Artificial Sequence; identical to SEQ ID NO: 74107
  derived and/or modified sequence opt1 from hemagglutinin__InfluenzaA__ALE32078

SEQ ID NO: 74572 - RNA, 1701 nt, Artificial Sequence; identical to SEQ ID NO: 73993
  derived and/or modified sequence opt1 from hemagglutinin__InfluenzaA__ALE32079

SEQ ID NO: 74573 - RNA, 1701 nt, Artificial Sequence
  derived and/or modified sequence opt1 from hemagglutinin__InfluenzaA__ALE32080
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccagcugcauccggcgcuccagcuccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcccagagcagcgggcgcaucaccguguccacgaagcggagccagcaggcggugaucccgaacaucggcucccgcccccggauccgcgacauccccagccggaucuccaucuacuggaccaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcacuccacccugaagcuggccaccggcaugcggaacguccccgagaagcagacccgcgggaucuucggcgcgaucgccggguucaucgagaacggcugggagggcaugguggacgggugguacggcuuccggcaccagaacagcgaggggcgcggccaggccgccgaccucaaguccacgcaggccgcgaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccggaacggcaccuacgaccacaacguguaccgcgacgaggcgcugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74574 - RNA, 1701 nt, Artificial Sequence; identical to SEQ ID NO: 74107
  derived and/or modified sequence opt1 from hemagglutinin__InfluenzaA__ALE32081

SEQ ID NO: 74575 - RNA, 1701 nt, Artificial Sequence; identical to SEQ ID NO: 74107
  derived and/or modified sequence opt1 from hemagglutinin__InfluenzaA__ALE32082

SEQ ID NO: 74576 - RNA, 1701 nt, Artificial Sequence
  derived and/or modified sequence opt1 from hemagglutinin__InfluenzaA__ALE32083
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcgcuccagcgggcggaucaccgugagcaccaagggcucccagcaggccgugaucccgaacaucggcagccgcccccggauccgcgacauccccucccggaucagcaucuacuggacgaucgucaagcccggggacauccugcugaucaacuccaccggcaaccucaucgccccgcgcggguacuucaagauccggagcggcaaguccagcaucaugcgcuccgacgcccccaucggcaagugcaagagcgagugcaucacccccaacggguccauccccaacgacaagccguuccagaacgugaaccggaucaccuacggcgccugcccccgcuacgugaagcacagcacgcugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagacgaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugaccgacuccgagaugaacaagcuguucgagcgcacgaagaagcagcuccgggagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 74577 - RNA, 1701 nt, Artificial Sequence; identical to SEQ ID NO: 74064
  derived and/or modified sequence opt1 from hemagglutinin__InfluenzaA__ALE32084

SEQ ID NO: 74578 - RNA, 1701 nt, Artificial Sequence; identical to SEQ ID NO: 74107
  derived and/or modified sequence opt1 from hemagglutinin__InfluenzaA__ALE32085

SEQ ID NO: 74579 - RNA, 1701 nt, Artificial Sequence
  derived and/or modified sequence opt1 from hemagglutinin__InfluenzaA__ALE32086
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucagcaagugcaaguccgagugcaucacccccaacggcagcauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacgggugggagggcaugguggacggcugguacggguuccggcaccagaacagcgagggccgcgggcaggccgccgaccucaaguccacgcaggcggccaucgaccagaucaacggcaagcugaaccggcugaucgggaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggguacaaggacuggauccuguggaucagcuucgccaucuccugcuuccugcucugcguggcccugcugggcuucaucaugugggccugccagaagggcaacauccgcugcaacaucugcaucuga

SEQ ID NO: 74580 - RNA, 1701 nt, Artificial Sequence
  derived and/or modified sequence opt1 from hemagglutinin__InfluenzaA__ALE32087
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucgacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaaccugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74581 - RNA, 1701 nt, Artificial Sequence
  derived and/or modified sequence opt1 from hemagglutinin__InfluenzaA__ALE32088
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccuccaccccgggaccgacaaggaccagaucuuccuguacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccguggaccucacggacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacaacgucuaccgcgacgaggcccucaacaaccgguuccagaucaaggggguggagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 74582 - RNA, 1701 nt, Artificial Sequence; identical to SEQ ID NO: 73449
  derived and/or modified sequence opt1 from hemagglutinin__InfluenzaA__ALE32089

SEQ ID NO: 74583 - RNA, 1701 nt, Artificial Sequence; identical to SEQ ID NO: 73449
  derived and/or modified sequence opt1 from hemagglutinin__InfluenzaA__ALE32090

SEQ ID NO: 74584 - RNA, 1701 nt, Artificial Sequence; identical to SEQ ID NO: 73449
  derived and/or modified sequence opt1 from hemagglutinin__InfluenzaA__ALE32091

SEQ ID NO: 74585 - RNA, 1701 nt, Artificial Sequence
  derived and/or modified sequence opt1 from hemagglutinin__InfluenzaA__ALE32092
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugccggagcgagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgagcacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74586 - RNA, 1701 nt, Artificial Sequence; identical to SEQ ID NO: 74055
  derived and/or modified sequence opt1 from hemagglutinin__InfluenzaA__ALE32093

SEQ ID NO: 74587 - RNA, 1701 nt, Artificial Sequence
  derived and/or modified sequence opt1 from hemagglutinin__InfluenzaA__ALE32094
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaccuccaccgggaaccucaucgccccgcgcggcuacuucaagauccggagcgggaaguccagcaucaugcgcuccgacgcccccaucggcaagugcaagagcgagugcaucacgcccaacggcuccauccccaacgacaagccguuccagaacgugaaccggaucaccuacggggccugcccccgcuacgugaagcacagcacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74588 - RNA, 1701 nt, Artificial Sequence; identical to SEQ ID NO: 73449
  derived and/or modified sequence opt1 from hemagglutinin__InfluenzaA__ALE32095

SEQ ID NO: 74589 - RNA, 1701 nt, Artificial Sequence
  derived and/or modified sequence opt1 from hemagglutinin__InfluenzaA__ALE32096
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucuccuacacguaccccgcccugaacgugaccaugcccaacaacgagcaguucgacaagcuguacaucuggggcguccaccaccccgggaccgacaaggaccagaucuuccucuacgcgcagagcagcgggcgcaucaccguguccacgaagcggagccagcaggccgugaucccgaacaucggcucccgcccccggauccgcgacauccccagccggaucuccaucuacuggaccaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74590 - RNA, 1701 nt, Artificial Sequence; identical to SEQ ID NO: 73449
  derived and/or modified sequence opt1 from hemagglutinin__InfluenzaA__ALE32097

SEQ ID NO: 74591 - RNA, 1701 nt, Artificial Sequence; identical to SEQ ID NO: 74055
  derived and/or modified sequence opt1 from hemagglutinin__InfluenzaA__ALE32099

SEQ ID NO: 74592 - RNA, 1701 nt, Artificial Sequence
  derived and/or modified sequence opt1 from hemagglutinin__InfluenzaA__ALE32100
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgaccugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74593 - RNA, 1701 nt, Artificial Sequence
  derived and/or modified sequence opt1 from hemagglutinin__InfluenzaA__ALE32101
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagccagugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccgggagcuucuucucccggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcggagcuccggccgcaucaccgugagcacgaagcggagccagcaggccgugaucccgaacaucggcucccgcccccggauccgcgacauccccagccggaucuccaucuacuggaccaucgucaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 74594 - RNA, 1701 nt, Artificial Sequence
  derived and/or modified sequence opt1 from hemagglutinin__InfluenzaA__ALE32102
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccuguccaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 74595 - RNA, 1701 nt, Artificial Sequence; identical to SEQ ID NO: 74162
  derived and/or modified sequence opt1 from hemagglutinin__InfluenzaA__ALE32103

SEQ ID NO: 74596 - RNA, 1701 nt, Artificial Sequence
  derived and/or modified sequence opt1 from hemagglutinin__InfluenzaA__ALE32104
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacccucgaguucaacaacgaguccuucaacuggacgggggugacccagaacggcaccagcuccgccugcauccgccggagcuccagcuccuucuucagccgccugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcggaucaccgugagcacgaagcgcucccagcaggccgugaucccgaacaucggcagccggccccgcauccgggacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74597 - RNA, 1701 nt, Artificial Sequence; identical to SEQ ID NO: 74107
  derived and/or modified sequence opt1 from hemagglutinin__InfluenzaA__ALE32105

SEQ ID NO: 74598 - RNA, 1701 nt, Artificial Sequence; identical to SEQ ID NO: 74107
  derived and/or modified sequence opt1 from hemagglutinin__InfluenzaA__ALE32106

SEQ ID NO: 74599 - RNA, 1701 nt, Artificial Sequence; identical to SEQ ID NO: 74162
  derived and/or modified sequence opt1 from hemagglutinin__InfluenzaA__ALE32107

SEQ ID NO: 74600 - RNA, 1701 nt, Artificial Sequence; identical to SEQ ID NO: 74392
  derived and/or modified sequence opt1 from hemagglutinin__InfluenzaA__ALE32108

SEQ ID NO: 74601 - RNA, 1701 nt, Artificial Sequence; identical to SEQ ID NO: 74006
  derived and/or modified sequence opt1 from hemagglutinin__InfluenzaA__ALE32109

SEQ ID NO: 74602 - RNA, 1701 nt, Artificial Sequence; identical to SEQ ID NO: 73993
  derived and/or modified sequence opt1 from hemagglutinin__InfluenzaA__ALE32110

SEQ ID NO: 74603 - RNA, 1701 nt, Artificial Sequence; identical to SEQ ID NO: 73449
  derived and/or modified sequence opt1 from hemagglutinin__InfluenzaA__ALE32111

SEQ ID NO: 74604 - RNA, 1701 nt, Artificial Sequence
  derived and/or modified sequence opt1 from hemagglutinin__InfluenzaA__ALE32112
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccaguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggcgugcccccgcuacgugaagcacagcacgcugaagcuggccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgcggaccucaagagcacccaggccgccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgcggaggacauggggaacggcugcuucaagaucuaccacaagugcgacaacgccugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggcgugccagaaggggaacauccgcugcaacaucugcaucuga

SEQ ID NO: 74605 - RNA, 1701 nt, Artificial Sequence
  derived and/or modified sequence opt1 from hemagglutinin__InfluenzaA__ALE32113
augaagaccaucaucgcccugagcuacauccucugccugguguucgcccagaagauccccggcaacgacaacuccaccgcgacgcugugccucgggcaccacgccgucccgaacggcaccguggugaagaccaucaccaacgaccgcaucgaggucacgaacgccaccgagcuggugcagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgucccggacuacgcgucccugcgcagccugguggccuccagcggcacccucgaguucaacaacgaguccuucaacuggacgggggugacccagaacggcaccagcuccgccugcauccgggggagcuccagcuccuucuucagccgccugaacuggcugacccaccucaacuacacguaccccgcccugaacgucaccaugcccaacaacgagcaguucgacaagcuguacaucuggggcgugcaccaccccgggaccgacaaggaccagaucuuccucuacgcgcaguccagcggccggaucaccgugagcacgaagcgcucccagcaggccgucaucccgaacaucggcagccggccccgcauccgggacauccccucccgcaucagcaucuacuggaccaucgugaagcccggggacauccugcugaucaacuccaccggcaaccucaucgccccgcggggguacuucaagaugcgcagcggcaaguccagcaucaugcgguccgacgcccccaucggcaagugcaagagcgagugcaucacccccaacggguccauccccaacgacaagccguuccagaacgugaaccgcaucacguacggcgccugcccccgguacgucaagcacagcacccugaagcuggcgaccgggaugcgcaacgugcccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacgucuaccgggacgaggcccugaacaaccgcuuccagaucaagggcguggagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 74606 - RNA, 1701 nt, Artificial Sequence; identical to SEQ ID NO: 73993
  derived and/or modified sequence opt1 from hemagglutinin__InfluenzaA__ALE32114

SEQ ID NO: 74607 - RNA, 1701 nt, Artificial Sequence; identical to SEQ ID NO: 73993
  derived and/or modified sequence opt1 from hemagglutinin__InfluenzaA__ALE32115

SEQ ID NO: 74608 - RNA, 1701 nt, Artificial Sequence
  derived and/or modified sequence opt1 from hemagglutinin__InfluenzaA__ALE32116
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacgugcgcugcaacaucugcaucuga

SEQ ID NO: 74609 - RNA, 1701 nt, Artificial Sequence
  derived and/or modified sequence opt1 from hemagglutinin__InfluenzaA__ALE32117
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgacuucaagagcacgcaggcggccaucgaccagaucaacgggaagcucaaccggcugaucggcaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcugaaguccgaguacaaggacuggauccucuggaucagcuucgccaucagcugcuuccugcugugcguggcccuccugggcuucaucaugugggccugccagaagggcaacauccgcugcaacaucugcaucuga

SEQ ID NO: 74610 - RNA, 1701 nt, Artificial Sequence; identical to SEQ ID NO: 74055
  derived and/or modified sequence opt1 from hemagglutinin__InfluenzaA__ALE32118

SEQ ID NO: 74611 - RNA, 1701 nt, Artificial Sequence; identical to SEQ ID NO: 63677
  derived and/or modified sequence opt1 from hemagglutinin__InfluenzaA__ALM06086

SEQ ID NO: 74612 - RNA, 1701 nt, Artificial Sequence; identical to SEQ ID NO: 71048
  derived and/or modified sequence opt1 from hemagglutinin__InfluenzaA__ALM06087

SEQ ID NO: 74613 - RNA, 1701 nt, Artificial Sequence
  derived and/or modified sequence opt1 from hemagglutinin__InfluenzaA__ALM06088
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccggggccaggaggggcgcaugaacuacuacuggacccugguggagcccggcgacaagaucaccuucgaggcgacggggaaccucguggucccccgguacgccuucaccauggagcgcaacgccggcagcggcaucaucaucuccgacacccccgugcacgacugcaacaccacgugccagaccccggagggggccaucaacaccagccugcccuuccagaacauccaccccaucaccaucggcaagugccccaaguacgugaaguccacgaagcugcggcucgccaccgggcugcgcaacgucccgagcauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggagaagaucgacggggugaagcucgagagcacccgcaucuaccagauccuggccaucuacuccaccgucgcgagcucccuggugcucguggucagccugggcgccaucagcuucuggaugugcuccaacggcagccugcagugccggaucugcaucuga

SEQ ID NO: 74614 - RNA, 1701 nt, Artificial Sequence; identical to SEQ ID NO: 71048
  derived and/or modified sequence opt1 from hemagglutinin__InfluenzaA__ALM06089

SEQ ID NO: 74615 - RNA, 1701 nt, Artificial Sequence
  derived and/or modified sequence opt1 from hemagglutinin__InfluenzaA__ALN39661
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcaucgcccugcugggcuucaucaugugggccugccagaaggggaacauccgcugcaacaucugcaucuga

SEQ ID NO: 74616 - RNA, 1701 nt, Artificial Sequence; identical to SEQ ID NO: 73982
  derived and/or modified sequence opt1 from hemagglutinin__InfluenzaA__ALN39662

SEQ ID NO: 74617 - RNA, 1701 nt, Artificial Sequence; identical to SEQ ID NO: 73449
  derived and/or modified sequence opt1 from hemagglutinin__InfluenzaA__ALN39663

SEQ ID NO: 74618 - RNA, 1701 nt, Artificial Sequence
  derived and/or modified sequence opt1 from hemagglutinin__InfluenzaA__ALN39664
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgagcggccgggugaccgugagcaccaagcgcucccagcaggccgucauccccaacaucggcagccggccccgcauccgggacauccccucccgcaucagcaucuacuggaccaucgugaagccgggggacauccugcucaucaacuccacgggcaaccugaucgcgccccggggguacuucaagauccgcagcggcaaguccagcaucaugcgguccgacgcccccaucggcaagugcaagagcgagugcaucacccccaacggguccaucccgaacgacaagcccuuccagaacgugaaccgcaucaccuacggcgccugcccccgguacgucaagcagagcacccugaagcucgccacggggaugcgcaacgugcccgagcggcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacgucuaccgcgacgaggcccucaacaaccgguuccagaucaagggcguggagcugaaguccggcuacaaggacuggauccuguggaucagcuucgccaucagcugcuuccuccugugcguggcccugcucggguucaucaugugggccugccagaagggcaacauccgcugcaacaucugcaucuga

SEQ ID NO: 74619 - RNA, 1701 nt, Artificial Sequence; identical to SEQ ID NO: 73449
  derived and/or modified sequence opt1 from hemagglutinin__InfluenzaA__ALN39665

SEQ ID NO: 74620 - RNA, 1701 nt, Artificial Sequence; identical to SEQ ID NO: 74055
  derived and/or modified sequence opt1 from hemagglutinin__InfluenzaA__ALN39666

SEQ ID NO: 74621 - RNA, 1701 nt, Artificial Sequence
  derived and/or modified sequence opt1 from hemagglutinin__InfluenzaA__ALN39667
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccagcggccggaucaccgugagcaccaagcgcucccagcaggccgugaccccgaacaucggcagccggccccgcauccggaacauccccucccgcaucagcaucuacuggacgaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacgcugaagcuggccaccgggaugcgcaacguccccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagacgaacgagaaguuccaccagaucgagaaggaguucuccgagguggaggggcggauccaggaccucgagaaguacguggaggacaccaagaucgaccuguggagcuacaacgccgagcugcucgucgcccuggagaaccagcacaccaucgaccugaccgacuccgagaugaacaagcuguucgagaagacgaagaagcagcuccgcgagaacgcggaggacaugggcaacgggugcuucaagaucuaccacaagugcgacaacgccugcaucggcagcauccgcaacgggaccuacgaccacgacguguaccggaacgaggcccugaacaaccgcuuccagaucaagggcguggagcucaaguccggcuacaaggacuggauccuguggaucagcuucgccaucagcugcuuccugcucugcgucgcccugcugggguucaucaugugggcgugccagaagggcaacauccggugcaacaucugcaucuga

SEQ ID NO: 74622 - RNA, 1701 nt, Artificial Sequence; identical to SEQ ID NO: 74524
  derived and/or modified sequence opt1 from hemagglutinin__InfluenzaA__ALN39668

SEQ ID NO: 74623 - RNA, 1701 nt, Artificial Sequence
  derived and/or modified sequence opt1 from hemagglutinin__InfluenzaA__ALN39669
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagcuguccgggcgcaucaccgugagcacgaagcggagccagcaggccgugaucccgaacaucggcucccgcccccggauccgcgacauccccagccggaucuccaucuacuggaccaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcacuccacccugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 74624 - RNA, 1701 nt, Artificial Sequence; identical to SEQ ID NO: 73449
  derived and/or modified sequence opt1 from hemagglutinin__InfluenzaA__ALN39670

SEQ ID NO: 74625 - RNA, 1701 nt, Artificial Sequence
  derived and/or modified sequence opt1 from hemagglutinin__InfluenzaA__ALN39671
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagacccgcaagcagcuccgggagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74626 - RNA, 1701 nt, Artificial Sequence; identical to SEQ ID NO: 73449
  derived and/or modified sequence opt1 from hemagglutinin__InfluenzaA__ALN39672

SEQ ID NO: 74627 - RNA, 1701 nt, Artificial Sequence
  derived and/or modified sequence opt1 from hemagglutinin__InfluenzaA__ALN39673
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccggacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74628 - RNA, 1701 nt, Artificial Sequence; identical to SEQ ID NO: 73989
  derived and/or modified sequence opt1 from hemagglutinin__InfluenzaA__ALN39674

SEQ ID NO: 74629 - RNA, 1701 nt, Artificial Sequence; identical to SEQ ID NO: 73449
  derived and/or modified sequence opt1 from hemagglutinin__InfluenzaA__ALN39675

SEQ ID NO: 74630 - RNA, 1701 nt, Artificial Sequence
  derived and/or modified sequence opt1 from hemagglutinin__InfluenzaA__ALN39676
augaagaccaucaucgcccugagcugcauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgagaacuucaacugggccggggugacgcagaacggcaccuccagcuccugcauccgggggagcaacuccagcuucuucucccgccugaacuggcucacccaccugaacagcaaguaccccgcccugaacgugaccaugcccaacaacgagcaguucgacaagcucuacaucuggggcguccaccaccccgggacggacaaggaccagaucuuccuguacgcgcaguccagcggccggaucaccgugagcaccaagcgcucccagcaggccgugaucccgaacaucggcagccggccccgcauccgggacauccccucccgcaucagcaucuacuggaccaucgucaagcccggggacauccugcucaucaacuccacgggcaaccugaucgccccgcggggguacuuccgcauccggagcggcaaguccagcaucaugcgcuccgacgcccccaucggcaagugcaagagcgagugcaucacccccaacggguccauccccaacgacaagccguuccagaacgugaaccggaucaccuacggcgccugcccccgcuacgugaagcagaacacccugaagcucgcgacggggaugcggaacguccccgagcgccagacccggggcaucuucggggccaucgccggcuucaucgagaacggcugggaggggaugguggacggcugguacggguuccgccaccagaacagcgagggccgggggcaggccgccgaccugaaguccacccagagcgcgaucgaccagaucaacggcaagcugaaccgccucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacaugggcaacgggugcuucaagaucuaccacaagugcgacaacgccugcaucggcagcauccgcaacgggacguacgaccacgacguguaccgggacgaggcgcucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 74631 - RNA, 1701 nt, Artificial Sequence
  derived and/or modified sequence opt1 from hemagglutinin__InfluenzaA__ALN39677
augaagaccaucaucgcccugggcuacauccucugccugguguucgcccagaagauccccgggaacgacaacagcaccgcgacgcugugccucggccaccacgccgucccgaacgggaccaucgugaagaccaucaccaacgaccgcaucgaggugacgaacgccaccgagcugguccagaacuccagcaucggcgagaucugcgacagcccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccagcuccgggacccucgaguucaacaacgagagcuucaacuggacgggcgugacccagaacgggaccuccagcgccugcauccggcgcuccagcuccagcuucuucucccggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccagagcuccggccgcaucaccgugagcaccaagcggagccagcaggccgugaucccgaacaucggcucccgcccccggauccgcgacauccccagccggaucuccaucuacuggacgaucgucaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgcgugcccccgcuacgugaagcacuccacgcugaagcuggccaccgggaugcggaacguccccgagaagcagacccgcggcaucuucggggccaucgccggcuucaucgagaacggcugggaggggaugguggacggcugguacggguuccggcaccagaacagcgagggccgcgggcaggccgcggaccucaaguccacccaggccgccaucgaccagaucaacggcaagcugaaccggcugaucggcaagacgaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgcggaggacaugggcaacgggugcuucaagaucuaccacaagugcgacaacgccugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggcgugccagaagggcaacauccgcugcaacaucugcaucuga

SEQ ID NO: 74632 - RNA, 1701 nt, Artificial Sequence; identical to SEQ ID NO: 74336
  derived and/or modified sequence opt1 from hemagglutinin__InfluenzaA__ALN39678

SEQ ID NO: 74633 - RNA, 1701 nt, Artificial Sequence
  derived and/or modified sequence opt1 from hemagglutinin__InfluenzaA__ALN39679
augaagaccaucaucgcccugggcuacauccucugccugguguucgcccagaagauccccgggaacgacaacagcaccgcgacgcugugccucggccaccacgccgucccgaacgggaccguggugaagaccaucaccaacgaccgcaucgaggucacgaacgccaccgagcuggugcagaacuccagcaucggcgagaucugcgacagcccccacaagauccuggacggggagaacugcacccucaucgacgcccugcugggcgacccccagugcgacggcuuccagaacaagaagugggaccucuucguggagcgguccaaggccuacuccaacugcuaccccuacgacgucccggacuacgcgagccugcgcucccugguggccagcuccgggacccucgaguucaacaacgagagcuucaacuggacgggcgugacccagaacgggaccuccagcgccugcauccggcgcuccagcuccagcuucuucucccggcugaacuggcugacccaccucaacuacacguaccccgcccugaacgucaccaugcccaacaacgagcaguucgacaagcuguacaucuggggcgugcaccaccccgggaccgacaaggaccagaucuuccucuacgcgcagagcuccggccgcaucaccgugagcacgaagcggagccagcaggccgucaucccgaacaucggcucccgcccccggauccgcgacauccccagccggaucuccaucuacuggaccaucgugaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucacguacggcgccugcccccgcuacgucaagcacuccacccugaagcuggcgaccgggaugcggaacgugcccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacgucuaccgcgacgaggcccugaacaaccgguuccagaucaagggcguggagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 74634 - RNA, 1701 nt, Artificial Sequence; identical to SEQ ID NO: 74336
  derived and/or modified sequence opt1 from hemagglutinin__InfluenzaA__ALN39680

SEQ ID NO: 74635 - RNA, 1701 nt, Artificial Sequence; identical to SEQ ID NO: 74336
  derived and/or modified sequence opt1 from hemagglutinin__InfluenzaA__ALN39681

SEQ ID NO: 74636 - RNA, 1701 nt, Artificial Sequence; identical to SEQ ID NO: 74336
  derived and/or modified sequence opt1 from hemagglutinin__InfluenzaA__ALN39682

SEQ ID NO: 74637 - RNA, 1701 nt, Artificial Sequence; identical to SEQ ID NO: 74336
  derived and/or modified sequence opt1 from hemagglutinin__InfluenzaA__ALN39683

SEQ ID NO: 74638 - RNA, 1701 nt, Artificial Sequence; identical to SEQ ID NO: 74336
  derived and/or modified sequence opt1 from hemagglutinin__InfluenzaA__ALN39684

SEQ ID NO: 74639 - RNA, 1701 nt, Artificial Sequence; identical to SEQ ID NO: 74336
  derived and/or modified sequence opt1 from hemagglutinin__InfluenzaA__ALN39685

SEQ ID NO: 74640 - RNA, 1701 nt, Artificial Sequence
  derived and/or modified sequence opt1 from hemagglutinin__InfluenzaA__ALN39686
augaagaccaucaucgcccugggcuacauccucugccuggccuucgcgcagaagauccccgggaacgacaacagcaccgccacgcugugccucggccaccacgccgugccgaacgggaccaucgucaagaccaucaccaacgaccgcaucgaggugacgaacgccaccgagcuggugcagaacuccagcaucggcgagaucugcgacagcccccacaagauccuggacggggagaacugcacccucaucgacgcccugcugggcgacccccagugcgacggcuuccagaacaagaagugggaccucuucgucgagcgguccaaggcguacuccaacugcuaccccuacgacgugccggacuacaccagccugcgcucccugguggccagcuccgggacgcucgaguucaacaacgagagcuucaacuggaccggcgucacccagaacgggaccuccagcgccugcauccggcgcuccagcuccagcuucuucucccggcugaacuggcugacgcaccucaacuacaccuaccccgcccugaacgugaccaugcccaacaacgagcaguucgacaagcuguacaucuggggcgugcaccaccccgggaccgacaaggaccagaucuuccucuacgcgcagagcuccggccgcaucacggucagcaccaagcggagccagcaggccgugaucccgaacaucggcucccgcccccggauccgcgacauccccagccggaucuccaucuacuggaccaucgugaagcccggggacauccugcugaucaacagcaccggcaaccucaucgccccgcgcggguacuucaagauccgguccggcaagagcuccaucaugcgcagcgacgcccccaucggcaagugcaaguccgagugcaucacgcccaacgggagcauccccaacgacaagccguuccagaacgucaaccggaucaccuacggcgccugcccccgcuacgugaagcacuccacccugaagcuggcgaccgggaugcggaacgugcccgagaagcagacgcgcggcaucuucggggccaucgccggcuucaucgagaacggcugggaggggauggucgacggcugguacggguuccggcaccagaacagcgagggccgcgggcaggccgccgaccucaaguccacccaggcggccaucgaccagaucaacggcaagcugaaccggcugaucggcaagaccaacgagaaguuccaccagaucgagaaggaguucagcgagguggaggggcgcauccaggaccucgagaaguacguggaggacaccaagaucgaccugugguccuacaacgccgagcugcucgucgcccuggagaaccagcacacgaucgaccugaccgacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcguggagcucaagagcggcuacaaggacuggauccuguggaucuccuucgccaucagcugcuuccugcucugcgucgcccugcugggguucaucaugugggccugccagaagggcaacauccgcugcaacaucugcaucuga

SEQ ID NO: 74641 - RNA, 1701 nt, Artificial Sequence; identical to SEQ ID NO: 74336
  derived and/or modified sequence opt1 from hemagglutinin__InfluenzaA__ALN39687

SEQ ID NO: 74642 - RNA, 1701 nt, Artificial Sequence
  derived and/or modified sequence opt1 from hemagglutinin__InfluenzaA__ALN39688
augaagaccaucaucgcccugggcuacauccucugccugguguucgcccagaagauccccgggaacgacaacagcaccgcgacgcugugccucggccaccacgccgucccgaacgggaccaucgugaagaccaucaccaacgaccgcaucgaggugacgaacgccaccgagcugguccagaacuccagcaucggcgagaucugcgacagcccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccagcuccgggacccucgaguucaacaacgagagcuucaacuggacgggcgugacccagaacgggaccuccagcgccugcauccggcgcuccagcuccagcuucuucucccggcugaacuggcugacccaccucaacuacaucuaccccgcccugaacgugacgaugcccaacaacgagcaguucgacaagcuguacaucuggggcguccaccaccccgggaccgacaaggaccagaucuuccucuacgcgcagagcuccggccgcaucaccgugagcaccaagcggagccagcaggccgugaucccgaacaucggcucccgcccccggauccgcgacauccccagccggaucuccaucuacuggacgaucgucaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgccugcccccgcuacgugaagcacuccacgcugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacccaggcggccaucgaccagaucaacggcaagcugaaccggcugaucggcaagacgaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 74643 - RNA, 1701 nt, Artificial Sequence
  derived and/or modified sequence opt1 from hemagglutinin__InfluenzaA__ALN39689
augaagaccaucaucgcccugggcuacauccucugccugguguucgcccagaagauccccgggaacgacaacagcaccgcgacgcugugccucggccaccacgccgucccgaacgggaccaucgugaagaccaucaccaacgaccgcaucgaggugacgaacgccaccgagcugguccagaacuccagcaucggcgagaucugcgacagcccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccagcuccgggacccucgaguucaacaacgagagcuucaacuggacgggcgugacccagaacgggaccuccagcgccugcauccggcgcuccagcuccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugagcacgaagcggagccagcaggccgugaucccgaacaucggcucccgcccccggauccgcgacauccccagccggaucuccaucuacuggaccaucgucaagcccggggacauccugcugauccacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 74644 - RNA, 1701 nt, Artificial Sequence
  derived and/or modified sequence opt1 from hemagglutinin__InfluenzaA__ALN39690
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcaagaacugcacccugaucgacgcccugcucggggacccccagugcgacggcuuccagaacaagaagugggaccuguucguggagcgguccaaggcccacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaucuaccccgcccugaacgugaccaugcccaacaacgagcaguucgacaagcucuacaucuggggcguccaccaccccgggacggacaaggaccagaucuuccuguacgcgcagagcagcggccggaucaccguguccaccaagcgcagccagcaggccgugaucccgaacaucggcucccggccccgcauccgggacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagcggcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacaacguguaccgcgacgaggcccucaacaaccgguuccagaucaagggcgucgagcucaagagcggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 74645 - RNA, 1701 nt, Artificial Sequence
  derived and/or modified sequence opt1 from hemagglutinin__InfluenzaA__ALN39691
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcaagaacugcacccugaucgacgcccugcucggggacccccagugcgacggcuuccagaacaagaagugggaccuguucguggagcgguccaaggcccacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgagcggccggaucaccgugagcaccaagcgcucccagcaggccgugauccccaacaucggcagccggccccgcauccgggacauccccucccgcaucagcaucuacuggaccaucgucaagccgggggacauccugcucaucaacuccacgggcaaccugaucgcgccccggggguacuucaagauccgcagcggcaaguccagcaucaugcgguccgacgcccccaucggcaagugcaagagcgagugcaucacccccaacggguccaucccgaacgacaagcccuuccagaacgugaaccgcaucaccuacggcgccugcccccgguacgugaagcagagcacccugaagcucgccacggggaugcgcaacguccccgagaagcagacccggggcaucuucggggccaucgccggcuucaucgagaacggcugggaggggaugaaggacggcugguacggguuccgccaccagaacuccgagggccgggggcaggccgccgaccucaagagcacccaggcggccaucgaccagaucaacggcaagcugaaccgccugaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 74646 - RNA, 1701 nt, Artificial Sequence; identical to SEQ ID NO: 74336
  derived and/or modified sequence opt1 from hemagglutinin__InfluenzaA__ALN39692

SEQ ID NO: 74647 - RNA, 1701 nt, Artificial Sequence; identical to SEQ ID NO: 74336
  derived and/or modified sequence opt1 from hemagglutinin__InfluenzaA__ALN39693

SEQ ID NO: 74648 - RNA, 1701 nt, Artificial Sequence; identical to SEQ ID NO: 74336
  derived and/or modified sequence opt1 from hemagglutinin__InfluenzaA__ALN39694

SEQ ID NO: 74649 - RNA, 1701 nt, Artificial Sequence; identical to SEQ ID NO: 74336
  derived and/or modified sequence opt1 from hemagglutinin__InfluenzaA__ALN39695

SEQ ID NO: 74650 - RNA, 1701 nt, Artificial Sequence; identical to SEQ ID NO: 74336
  derived and/or modified sequence opt1 from hemagglutinin__InfluenzaA__ALN39696

SEQ ID NO: 74651 - RNA, 1701 nt, Artificial Sequence; identical to SEQ ID NO: 74006
  derived and/or modified sequence opt1 from hemagglutinin__InfluenzaA__ALN39697

SEQ ID NO: 74652 - RNA, 1701 nt, Artificial Sequence
  derived and/or modified sequence opt1 from hemagglutinin__InfluenzaA__ALN39698
augaagaccaucaucgcccugagccacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcauggggagcauccggaacggcaccuacgaccacaacguguaccgcaacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 74653 - RNA, 1701 nt, Artificial Sequence
  derived and/or modified sequence opt1 from hemagglutinin__InfluenzaA__ALN39700
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacaucaagugcaacaucugcaucuga

SEQ ID NO: 74654 - RNA, 1701 nt, Artificial Sequence; identical to SEQ ID NO: 74055
  derived and/or modified sequence opt1 from hemagglutinin__InfluenzaA__ALN39701

SEQ ID NO: 74655 - RNA, 1701 nt, Artificial Sequence
  derived and/or modified sequence opt1 from hemagglutinin__InfluenzaA__ALN39702
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcuccaucugcaucuga

SEQ ID NO: 74656 - RNA, 1701 nt, Artificial Sequence
  derived and/or modified sequence opt1 from hemagglutinin__InfluenzaA__ALN39703
augaagaccaucaucgcccugagcuacauccucugccugguguucgcccagaagauccccggcaacgacgacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74657 - RNA, 1701 nt, Artificial Sequence; identical to SEQ ID NO: 74055
  derived and/or modified sequence opt1 from hemagglutinin__InfluenzaA__ALN39704

SEQ ID NO: 74658 - RNA, 1701 nt, Artificial Sequence; identical to SEQ ID NO: 73449
  derived and/or modified sequence opt1 from hemagglutinin__InfluenzaA__ALN39705

SEQ ID NO: 74659 - RNA, 1701 nt, Artificial Sequence
  derived and/or modified sequence opt1 from hemagglutinin__InfluenzaA__ALN39706
augaagaccaucaucgcccugagcuacauccucugccugguguucgcccagaagcugcccggcaacgacaacuccaccgcgacgcucugccuggggcaccacgccgucccgaacggcaugaucgugaagaccaucaccaacgaccgcaucgaggugaccaacgccacggagcugguccagaacagcuccaucggggagaucugcgacagcccccaccagauccucgacggcaagaacugcacccugaucgacgcccugcucggggacccccagugcgacgacuuccagaacaagcggugggaccuguucguggagcgcuccaaggccuacagcaacugcuaccccuacgacgugccggacuacgcgucccugcggagccucgucgccuccagcggcacccuggaguucaacgacgaguccuucaacugggccggcgugacccagaacgggacgagcuccgccugcauccgcggcagcaacuccagcuucuucucccggcugaacuggcucacccacagcaacuucaaguaccccgcgcugaacgugaccaugcccaacaacgagcaguucgacaagcuguacaucuggggcguccaccaccccgggaccgacaaggaccagaucuuccucuacgcccaguccagcgggcgcaucacggugagcaccaagcggucccagcaggccgugaucccgaacaucggcagccgcccccggauccgcaacauccccucccggaucagcaucuacuggaccaucgucaagcccggcgacauccugcugaucaacuccaccgggaaccucaucgccccgcgcggcuacuucaagauccagagcgggaaguccagcaucaugcgguccgacgcccccaucggcaagugcaagagcgagugcaucacgcccaacggcuccauccccaacgacaagccguuccagaacgugaaccgcaucaccuacggggcgugcccccgguacgugaagcagagcacccugaagcuggccaccggcaugcgcaacguccccgagaagcagacgcgggggaucuucggcgccaucgccggguucaucgagaacggcugggagggcaugaaggacgggugguacggcuuccgccaccagaacuccgaggggcggggccaggccgcggaccucaagagcacccaggccgccaucgaccagaucaacgggaagcugaaccgccugaucggcaagaccaacgagaaguuccaccagaucgagaaggaguucuccgagguggagggccggauccaggaccucgagaaguacguggaggacaccaagaucgaccuguggagcuacaacgccgagcugcucgucgcccuggagaaccagcacacgaucgaccugaccgacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacguguaccgggacgaggcccugaacaaccgcuuccagaucaaggggguggagcucaaguccggcuacaaggacuggauccuguggaucagcuucgccaucagcugcuuccugcucugcgucgcccugcugggcuucaucaugugggcgugccagaaggggaacauccggugcaacaucugcaucuga

SEQ ID NO: 74660 - RNA, 1701 nt, Artificial Sequence; identical to SEQ ID NO: 73449
  derived and/or modified sequence opt1 from hemagglutinin__InfluenzaA__ALN39707

SEQ ID NO: 74661 - RNA, 1701 nt, Artificial Sequence; identical to SEQ ID NO: 74055
  derived and/or modified sequence opt1 from hemagglutinin__InfluenzaA__ALN39708

SEQ ID NO: 74662 - RNA, 1701 nt, Artificial Sequence
  derived and/or modified sequence opt1 from hemagglutinin__InfluenzaA__ALN39709
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcaugcggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagagcagcggccggaucaccguguccaccaagcgcagccagcaggccgugaccccgaacaucggcucccggccccgcauccgggacauccccagccgcaucuccaucuacuggacgaucgucaagcccggggacauccugcucaucaacagcaccggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacgcugaagcucgcgaccgggaugcgcaacguccccgagcggcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcucaagagcggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 74663 - RNA, 1701 nt, Artificial Sequence; identical to SEQ ID NO: 74379
  derived and/or modified sequence opt1 from hemagglutinin__InfluenzaA__ALN39710

SEQ ID NO: 74664 - RNA, 1701 nt, Artificial Sequence; identical to SEQ ID NO: 74055
  derived and/or modified sequence opt1 from hemagglutinin__InfluenzaA__ALN39711

SEQ ID NO: 74665 - RNA, 1701 nt, Artificial Sequence; identical to SEQ ID NO: 73449
  derived and/or modified sequence opt1 from hemagglutinin__InfluenzaA__ALN39712

SEQ ID NO: 74666 - RNA, 1701 nt, Artificial Sequence
  derived and/or modified sequence opt1 from hemagglutinin__InfluenzaA__ALN39713
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgggggagcuccagcuccuucuucagccgccugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcggccggaucaccgugagcacgaagcgcucccagcaggccgugaucccgaacaucggcagccggccccgcauccgggacauccccucccgcaucagcaucuacuggaccaucgucaagcccggggacauccugcugaucaacuccaccggcaaccucaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 74667 - RNA, 1701 nt, Artificial Sequence
  derived and/or modified sequence opt1 from hemagglutinin__InfluenzaA__ALN39714
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacugggccggggugacgcagaacggcaccagcuccagcugcauccggggguccaacagcuccuucuucagccgccugaacuggcugacccaccucaacuccaaguaccccgcccugaacgugaccaugcccaacaacgagcaguucgacaagcuguacaucuggggcguccaccaccccgggacggacaaggaccagaccuuccucuacgcgcagccgagcggccggaucaccgugagcaccaagcgcucccagcaggccgugauccccaacaucggcagccggccccgcauccgggacauccccucccgcaucagcaucuacuggacgaucgucaagccgggggacauccugcugaucaacuccaccggcaaccucaucgcgccccggggguacuucaagauccgcagcggcaaguccagcaucaugcgguccgacgcccccaucggcaagugcaagagcgagugcaucacccccaacggguccaucccgaacgacaagcccuuccagaacgugaaccgcaucaccuacggcgccugcccccgguacgugaagcagagcacgcugaagcuggccaccgggaugcgcaacguccccgagcggcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagacgaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 74668 - RNA, 1701 nt, Artificial Sequence; identical to SEQ ID NO: 74107
  derived and/or modified sequence opt1 from hemagglutinin__InfluenzaA__ALN39715

SEQ ID NO: 74669 - RNA, 1701 nt, Artificial Sequence; identical to SEQ ID NO: 73449
  derived and/or modified sequence opt1 from hemagglutinin__InfluenzaA__ALN39716

SEQ ID NO: 74670 - RNA, 1701 nt, Artificial Sequence; identical to SEQ ID NO: 73449
  derived and/or modified sequence opt1 from hemagglutinin__InfluenzaA__ALN39717

SEQ ID NO: 74671 - RNA, 1701 nt, Artificial Sequence; identical to SEQ ID NO: 74487
  derived and/or modified sequence opt1 from hemagglutinin__InfluenzaA__ALN39718

SEQ ID NO: 74672 - RNA, 1701 nt, Artificial Sequence; identical to SEQ ID NO: 73449
  derived and/or modified sequence opt1 from hemagglutinin__InfluenzaA__ALN39734

SEQ ID NO: 74673 - RNA, 1701 nt, Artificial Sequence
  derived and/or modified sequence opt1 from hemagglutinin__InfluenzaA__ALN39735
augaagaccaucaucgcccugagcuacauccucugccugguguucgcccagaagauccccggcaacgacaacuccaccgcgacgcugugccucgggcaccacgccgucccgaacggcaccaucgugaagaccaucaccgacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74674 - RNA, 1701 nt, Artificial Sequence
  derived and/or modified sequence opt1 from hemagglutinin__InfluenzaA__ALN39736
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagccguccgggcgcaucaccgugagcacgaagcggagccagcaggccgugauccccaacaucggcucccgcccccggauccgcgacauccccagccggaucuccaucuacuggaccaucgucaagccgggcgacauccugcugaucaacagcaccgggaaccucaucgcgccccgcggcuacuucaagauccgcgggggcaaguccagcaucaugcgguccgacgcccccaucggcaagugcaagagcgagugcaucacccccaacggguccaucccgaacgacaagcccuuccagaacgugaaccggaucacguacggcgccugcccccgcuacgugaagcacagcacccugaagcuggccaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacgcaggcggccaucgaccagaucaacggcaagcugaaccggcugaucggcaagaccaacgagaaguuccaccagaucgagaaggaguucuccgagguggaggggcgcauccagaaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccggaacgggaccuacgaccacaacguguaccgcgacgaggcccugaacaaccgguuccagaucaagggcgucgagcucaaguccggcuacaaggacuggauccuguggaucagcuucgccaucuccugcuuccugcucugcguggcccugcugggguucaucaugugggccugccagaagggcaacauccgcugcaacaucugcaucuga

SEQ ID NO: 74675 - RNA, 1701 nt, Artificial Sequence; identical to SEQ ID NO: 74055
  derived and/or modified sequence opt1 from hemagglutinin__InfluenzaA__ALN39737

SEQ ID NO: 74676 - RNA, 1701 nt, Artificial Sequence
  derived and/or modified sequence opt1 from hemagglutinin__InfluenzaA__ALN39738
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccucugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcuccagcuccuucuucagccggcugaacuggcucacccaccugaacuacacguaccccgcccugaacgugaccaugcccaacaacgagcaguucgacaagcucuacaucuggggcguccaccaccccgggaccgacaaggaccagaucuuccuguacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcacagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 74677 - RNA, 1701 nt, Artificial Sequence
  derived and/or modified sequence opt1 from hemagglutinin__InfluenzaA__ALN39739
augaagaccaucaucgcccugggcuacauccucugccugguguucgcccagaagauccccgggaacgacaacagcaccgcgacgcugugccucggccaccacgccgucccgaacgggaccaucgugaagaccaucaccaacgaccgcaucgaggugacgaacgccaccgagcugguccagaacuccagcaucggcgagaucugcgacagcccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccagcuccgggacccucgaguucaacaacgagagcuucaacuggacgggcgugacccagaacgggaccuccagcgccugcauccggcgcuccagcuccagcuucuucucccggcugaacuggcugacccaccucgacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugagcacgaagcggagccagcaggccgugaucccgaacaucggcucccgcccccggauccgcgacauccccagccggaucuccaucuacuggaccaucgucaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 74678 - RNA, 1701 nt, Artificial Sequence
  derived and/or modified sequence opt1 from hemagglutinin__InfluenzaA__ALN39740
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccguccccaacaacgagcaguucgacaagcuguacaucuggggcgugcaccaccccgggaccgacaaggaccagaucuuccucuacgcgcgguccagcgggcgcaucaccgugagcacgaagcggucccagcaggccgucaucccgaacaucggcuaccgcccccggauccgcgacauccccagccggaucuccaucuacuggaccaucgugaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgucaagcacuccacccugaagcuggcgaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacgucuaccgcgacgaggcccugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 74679 - RNA, 1701 nt, Artificial Sequence; identical to SEQ ID NO: 73449
  derived and/or modified sequence opt1 from hemagglutinin__InfluenzaA__ALN39741

SEQ ID NO: 74680 - RNA, 1701 nt, Artificial Sequence
  derived and/or modified sequence opt1 from hemagglutinin__InfluenzaA__ALN39742
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugagcacgaagcggucccagcaggccgugaucccgaacaucggcagccgcccccggauccgcgacauccccucccggaucagcaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggacugcccccgcuacgugaagcacagcacccugaagcuggccaccggcaugcggaacguccccgagaagcagacccgcgggaucuucggcgcgaucgccggguucaucgagaacggcugggagggcaugguggacgggugguacggcuuccggcaccagaacuccgaggggcgcggccaggccgccgaccucaagagcacgcaggccgcgaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggagcauccggaacggcaccuacgaccacaacguguaccgcgacgaggcgcugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74681 - RNA, 1701 nt, Artificial Sequence
  derived and/or modified sequence opt1 from hemagglutinin__InfluenzaA__ALN39743
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacaucuaccccgcccugaacgugacgaugcccaacaacgagcaguucgacaagcuguacaucuggggcguccaccaccccgggaccgacaaggaccagaucuuccucuacgcgcaguccagcgggcggaucaccgugagcaccaagcgcucccagcaggccgugaucccgaacaucggcagccggccccgcauccgggacauccccucccgcaucagcaucuacuggacgaucgucaagcccggcgacauccugcugaucaacuccaccgggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucaccuacggggccugcccccgguacgugaagcacagcacgcugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74682 - RNA, 1701 nt, Artificial Sequence
  derived and/or modified sequence opt1 from hemagglutinin__InfluenzaA__ALN39744
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcggaucaccgugagcacgaagcgcucccagcaggccgugaucccgaacaucggcagccggccccgcauccgggacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74683 - RNA, 1701 nt, Artificial Sequence
  derived and/or modified sequence opt1 from hemagglutinin__InfluenzaA__ALN39745
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgcaagagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccagcgggcggaucaccgugagcaccaagcgcucccagcaggccgugaucccgaacaucggcagccggccccgcauccgggacauccccucccgcaucagcaucuacuggacgaucgucaagcccggcgacauccugcugaucaacuccaccgggaaccucaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucaccuacggggccugcccccgguacgugaagcacagcacgcugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 74684 - RNA, 1701 nt, Artificial Sequence; identical to SEQ ID NO: 74682
  derived and/or modified sequence opt1 from hemagglutinin__InfluenzaA__ALN39746

SEQ ID NO: 74685 - RNA, 1701 nt, Artificial Sequence; identical to SEQ ID NO: 74377
  derived and/or modified sequence opt1 from hemagglutinin__InfluenzaA__ALN39747

SEQ ID NO: 74686 - RNA, 1701 nt, Artificial Sequence
  derived and/or modified sequence opt1 from hemagglutinin__InfluenzaA__ALN39748
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccaguccagcgggcgcaucaccgugagcaccaagcggucccagcaggccgugaucccgaacaucggcagccgcccccggauccgcgacauccccucccggaucagcaucuacuggacgaucgucaagcccggcgacauccugcugaucaacuccaccgggaaccucaucgccccgcgcggcuacuucaagauccugagcgggaaguccagcaucaugcgguccgacgcccccaucggcaagugcaagagcgagugcaucacccccaacggcuccauccccaacgacaagccguuccagaacgugaaccgcaucaccuacggggcgugcccccgguacgugaagcacagcacgcugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagagcacccaggccgccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgcggaggacauggggaacggcugcuucaagaucuaccacaagugcgacaacgccugcaucgggagcauccgcaacggcaccuacgaccacaacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggcgugccagaaggggaacauccggugcaacaucugcaucuga

SEQ ID NO: 74687 - RNA, 1701 nt, Artificial Sequence
  derived and/or modified sequence opt1 from hemagglutinin__InfluenzaA__ALN39749
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgagcggccggaucaccgugagcaccaagcgcucccagcaggccgugauccccaacaucggcagccggccccgcauccgggacauccccucccgcaucagcaucuacuggaccaucgucaagccgggggacauccugcucaucaacuccacgggcaaccugaucgcgccccggggguacuucaagauccgcagcggcaaguccagcaucaugcgguccgacgcccccaucggcaagugcaagagcgagugcaucacccccaacggguccaucccgaacgacaagcccuuccagaacgugaaccgcaucaccuacggcgccugcccccgguacgugaagcagagcacccugaagcucgccacggggaugcgcaacguccccgagcggcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcgucgagcugaaguccggcuacaaggacuggauccuguggaucagcuucgccaucagcugcuuccuccugugcguggcccugcucggguucaucaugugggccugccagaagggcaacauccgcugcaacaucugcaucuga

SEQ ID NO: 74688 - RNA, 1701 nt, Artificial Sequence; identical to SEQ ID NO: 73449
  derived and/or modified sequence opt1 from hemagglutinin__InfluenzaA__ALN39750

SEQ ID NO: 74689 - RNA, 1701 nt, Artificial Sequence; identical to SEQ ID NO: 73449
  derived and/or modified sequence opt1 from hemagglutinin__InfluenzaA__ALN39789

SEQ ID NO: 74690 - RNA, 1701 nt, Artificial Sequence; identical to SEQ ID NO: 73979
  derived and/or modified sequence opt1 from hemagglutinin__InfluenzaA__ALO75895

SEQ ID NO: 74691 - RNA, 1701 nt, Artificial Sequence
  derived and/or modified sequence opt1 from hemagglutinin__InfluenzaA__ALO75907
auggagaagaucgugcugcuccuggccaucgucagccuggugaagggcgaccagaucugcaucggguaccacgccaacaacuccaccgagcaggucgacaccaucauggagaagaacgugacggugacccacgcgcaggacauccucgagaagacccacaacggcaagcugugcgaccugaacggggugaagccccucauccugaaggacugcagcgucgccggcugguuccuggggaaccgcaugugcgacgaguucauccgggugccggagugguccuacaucguggagcgcgccaaccccgccaacgaccucugcuaccccggcaaccugaacgacuacgaggagcugaagcaccuccugagccggaucaaccacuucgagaagacccugaucauccccaaguccagcuggccgaaccacacguccagcggcgucuccgccgcgugccccuaccaggggaugcccagcuucuuccgcaacgugguguggcucaccaagaagaacgacgccuaccccaccaucaagauguccuacaacaacaccuaccgggaggaccugcugauccucuggggcauccaccacagcaacaacgccgccgagcagacgaaccuguacaagaacccgaccaccuacgucuccguggggaccagcacgcugaaccagcgccucgagcccaagaucgcgacccggucccaggugaacggccagcgcgggcggauggacuucuucuggaccauccugaagcccaacgacgccauccacuucgagagcaacggcaacuucaucgcccccgaguacgccuacaagaucgucaagaagggcgacuccaccaucaugaaguccgagauggaguacgggcacugcaacacgaagugccagaccccgaucggcgccaucaacagcagcaugcccuuccacaacauccacccccugaccaucggggagugccccaaguacgucaagagcaacaagcucgugcuggcgaccggccugcgcaacuccccgcuccgggagcgccggcgcaagcggggccuguucggggccaucgccggcuucaucgagggcggguggcaggggaugguggacggcugguacggcuaccaccacagcaacgagcagggguccggcuacgccgccgaccgcgagagcacgcagaaggcgaucgacggggugaccaacaaggugaacuccaucaucgacaagaugaacacccaguucgaggccgucggccgggaguucaacaaccuggagcgccggaucgagaaccucaacaagaagauggaggacggguuccuggacguguggaccuacaacgccgagcugcucgugcugauggagaacgagcgcacgcuggacuuccacgacagcaacgucaagaaccucuacgacaaggugcggcugcagcugcgcgacaacgccaaggagcucggcaacggcugcuucgaguucuaccacaagugcgacaacgagugcauggaguccguccgcaacgggaccuacgacuacccccuguacagcgaggaggcccggcugaagcgcgaggagaucuccggcgugaagcucgagagcaucgggaccuaccagauccuguccaacuacagcaccguggcguccagccuggcccucgccaucaucgucgccggccugucccuguggaugugcagcaacgggucccuccagugccggaucugcaucuga

SEQ ID NO: 74692 - RNA, 1701 nt, Artificial Sequence
  derived and/or modified sequence opt1 from hemagglutinin__InfluenzaA__ALO75919
auggagaagaucgugcugcuccuggccaucgucagccuggugaagggcgaccagaucugcaucggguaccacgccaacaacuccaccgagcaggucgacaccaucauggagaagaacgugacggugacccacgcgcaggacauccucgagaagacccacaacggcaagcugugcgaccugaacggggugaagccccucauccugaaggacugcagcgucgccggcuggcugcacgggaaccgcaugugcgacgaguucauccgggugccggagugguccuacaucguggagcgcgccaaccccgccaacgaccucugcuaccccggcaaccugaacgacuacgaggagcugaagcaccuccugagccggaucaaccacuucgagaagacccugaucauccccaaguccagcuggccgaaccacacguccagcggcgucuccgccgcgugccccuaccaggggaugcccagcuucuuccgcaacgugguguggcucaccaagaagaacgacgccuaccccaccaucaagauguccuacaacaacaccuaccgggaggaccugcugauccucuggggcauccaccacagcaacaacgccgccgagcagacgaaccuguacaagaacccgaccaccuacgucuccguggggaccagcacgcugaaccagcgccucgagcccaagaucgcgacccggucccaggugaacggccagcgcgggcggauggacuucuucuggaccauccugaagcccaacgacgccauccacuucgagagcaacggcaacuucaucgcccccgaguacgccuacaagaucgucaagaagggcgacuccaccaucaugaaguccgagauggaguacgggcacugcaacacgaagugccagaccccgaucggcgccaucaacagcagcaugcccuuccacaacauccacccccugaccaucggggagugccccaaguacgucaagagcaacaagcucgugcuggcgaccggccugcgcaacuccccgcuccgggagcgccggcgcaagcggggccuguucggggccaucgccggcuucaucgagggcggguggcaggggaugguggacggcugguacggcuaccaccacagcaacgagcagggguccggcuacgccgccgaccgcgagagcacgcagaaggcgaucgacggggugaccaacaaggugaacuccaucaucgacaagaugaacacccaguucgaggccgucggccgggaguucaacaaccuggagcgccggaucgagaaccucaacaagaagauggaggacggguuccuggacguguggaccuacaacgccgagcugcucgugcugauggagaacgagcgcacgcuggacuuccacgacagcaacgucaagaaccucuacgacaaggugcggcugcagcugcgcgacaacgccaaggagcucggcaacggcugcuucgaguucuaccacaagugcgacaacgagugcauggaguccguccgcaacgggaccuacgacuacccccuguacagcgaggaggccucccugaagcgggaggagaucagcggcgugaagcucgaguccaucgggaccuaccagauccugagcaucuacuccaccguggcgagcucccuggcccucgccaucaucgucgccggccugagccuguggaugugcuccaacgggagccuccagugccgcaucugcaucuga

SEQ ID NO: 74693 - RNA, 1683 nt, Artificial Sequence
  derived and/or modified sequence opt1 from hemagglutinin__InfluenzaA__ALT20080
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugagccuggaggggcgcgagugguccuacaucguggagcggcccagcgccgucaacggccucugcuaccccggcaacguggagaaccuggaggagcugcgcucccucuucagcuccgcccggagcuaccagcgcauccagaucuucccggacaccaucuggaacguguccuacgacgggaccagcaccgccugcuccggcagcuucuaccgguccaugcgcuggcugacccggaagaacggggacuaccccauccaggacgcgcaguacaccaacaaccagggcaagaacauccuguucaugugggggaucaaccacccgcccacggacaccacccagcgcgaccucuacacccggacggacaccaccaccagcgucgccacggaggagaucaaccgcaucuucaagccccugaucggcccccggccccuggugaacggccucauggggcgcaucgacuacuacugguccgugcugaagcccggccagacccugcggaucaagagcgacgggaaccucaucgccccgugguucggccacauccugagcggcgagucccacgggcgcauccugaagaccaaccucaagcggggcagcugcaccguccagugccagacggagaagggcgggcugaacaccacccugcccuuccagaacguguccaaguacgccuucgggaacugcagcaaguacaucggcaucaagucccucaagcuggcggugggccugcgcaacguccccagccgguccagccgcggccucuucggggccaucgccggguucaucgagggcgggugguccggccugguggccggcugguacggguuccagcacagcaacgaccagggcguggggauggccgcggaccgggacuccacccagaaggccaucgacaagaucacgagcaaggucaacaacaucguggacaagaugaacaagcaguacgagaucaucgaccacgaguucuccgagguggagacccgccugaacaugaucaacaacaagaucgacgaccagauccaggacaucugggccuacaacgccgagcuccugguccugcucgagaaccagaagacccuggacgagcacgacgccaacgugaacaaccuguacaacaaggugaagcgggcgcucggcagcaacgccgucgaggacgggaagggcugcuucgagcuguaccacaagugcgacgaccagugcauggagaccauccgcaacggcacguacaaccgccggaaguaccaggaggaguccaagcuggagcgccagaagaucgagggggugaagcucgagagcgagggcaccuacaagauccugaccaucuacuccaccgucgccagcucccuggugaucgccaugggguucgccgcguuccucuucugggccaugagcaacggcagcugccggugcaacaucugcaucuga

SEQ ID NO: 74694 - RNA, 1701 nt, Artificial Sequence
  derived and/or modified sequence opt1 from hemagglutinin__InfluenzaA__ALT66860
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgccagcucccuggugcucguggucagccugggggcgaucuccuucuggaugugcagcaacggcagccugcagugccggaucugcaucuga

SEQ ID NO: 74695 - RNA, 1701 nt, Artificial Sequence
  derived and/or modified sequence opt1 from hemagglutinin__InfluenzaA__AMA65391
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccggggccaggaggggcgcaugaacuacuacuggacgcugguggagcccggcgacaagaucaccuucgaggccaccgggaaccucguggucccccgguacgcguucaccauggagcgcaacgccggcagcggcaucaucaucuccgacacgcccgugcacgacugcaacacgaccugccagaccccggagggggccaucaacaccagccugcccuuccagaacauccaccccaucaccaucggcaagugccccaaguacgugaaguccaccaagcugcggcucgccaccgggcugcgcaacgucccgagcauccagucccggggccuguucggggccaucgcgggcuucaucgagggcggguggacgggcaugguggacgggugguacggcuaccaccaccagaacgagcaggggagcggcuacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggagaagaucgacggggugaagcucgagagcacccgcaucuaccagauccuggccaucuacuccaccgucgccagcucccuggugcucguggucuuccugggcgcgaucagcuucuggaugugcuccaacggcagccugcagugccggaucugcaucuga

SEQ ID NO: 74696 - RNA, 1701 nt, Artificial Sequence
  derived and/or modified sequence opt1 from hemagglutinin__InfluenzaA__AMA65393
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacucccccgucgccagcucccuggugcucguggucuuccugggggcgaucagcuucuggaugugcuccaacggcagccugcagugccggaucugcaucuga

SEQ ID NO: 74697 - RNA, 1701 nt, Artificial Sequence
  derived and/or modified sequence opt1 from hemagglutinin__InfluenzaA__BAA02768
augaaggccaagcugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaaggagagcugguccuacaucgccgagacccccaacagcgagaacgggaccugcuaccccggcuacuucgccgacuacgaggagcuccgggagcagcuguccagcguguccagcuucgagcgcuucgagaucuuccccaaggaguccagcuggccgaaccacacggucaccaagggggugaccgccuccugcagccacaacggcaaguccagcuucuaccggaaccugcucuggcugaccgggaagaacggccuguaccccaaccucuccaagagcuacgugaacaacaaggagaaggagguccuggugcuguggggcgugcaccaccccagcaacaucggcgaccagcgcgccaucuaccacacggagaacgcguacgucuccguggugagcucccacuacagccggcgcuucacccccgagaucgccaagcggccgaagguccgcggccaggaggggcggaucaacuacuacuggacccuccuggagcccggcgacaccaucaucuucgaggccaacgggaaccugaucgcccccugguacgccuucgcgcucucccgcggcuucggcagcgggaucaucacguccaacgccagcauggacgagugcgacgccaagugccagacgccccagggcgccaucaacuccagccugccguuccagaacgugcaccccgugaccaucggggagugccccaaguacguccgguccaccaagcugcgcauggugaccggccuccggaacauccccagcauccagucccgcgggcuguucggcgccaucgcgggcuucaucgagggcggguggaccgggaugaucgacggcugguacggguaccaccaccagaacgagcagggcagcggcuacgccgccgaccagaaguccacccagaacgccaucaacgggaucaccaacaaggugaacagcgucaucgagaagaugaacacgcaguucaccgccgugggcaaggaguucaacaagcuggagcggcgcauggaguaccucaacaagaagguggacgacggguuccuggacaucuggaccuacaacgcggagcugcucguccugcuggagaacgagcggacccucgacuuccacgacuccaacgugaagaaccuguacgagaaggucaagagccagcugaagaacaacgccaaggagaucggcuacgggugcuucgaguucuaccacaagugcaacaacgagugcauggaguccgugaagaacggcacguacgacuacccgaaguacagcgaggagagcaagcucaaccgcgagaagaucgacggcgugaagcuggaguccaugggggucuaccagauccuggccaucuacagcaccguggccuccagccucgugcugcuggucucccucggcgccaucagcuucuggaugugcuccaacgggagccugcagugccggaucugcaucuga

SEQ ID NO: 74698 - RNA, 1701 nt, Artificial Sequence
  derived and/or modified sequence opt1 from hemagglutinin__InfluenzaA__BAA02769
augaaggccaagcugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaaggagagcugguccuacaucgccgagacccccaacagcgagaacgggaccugcuaccccggcuacuucgccgacuacgaggagcuccgggagcagcuguccagcguguccagcuucgagcgcuucgagaucuuccccaaggaguccagcuggccgaaccacacggucaccaagggggugaccgccuccugcagccacaacggcaaguccagcuucuaccggaaccugcucuggcugaccgggaagaacggccuguaccccaaccucuccaagagcuacgugaacaacaaggagaaggagguccuggugcuguggggcgugcaccaccccagcaacauccgcgaccagcgggccaucuaccacacggagaacgcguacgucuccguggugagcucccacuacagccgccgguucacccccgagaucgccaagcgcccgaagguccgggaccaggagggccgcaucaacuacuacuggacccuccuggagcccggcgacaccaucaucuucgaggccaacgggaaccugaucgcccccugguacgccuucgcgcucucccggggcuucgggagcggcaucaucacguccaacgccagcauggacgagugcgacgccaagugccagacgccccagggcgccaucaacuccagccugccguuccagaacgugcaccccgugaccaucggggagugccccaaguacguccgcuccaccaagcugcggauggugaagggccuccgcaacauccccagcauccagucccgggggcuguucggcgccaucgcgggguucaucgagggcggcuggaccgggaugaucgacggcugguacggguaccaccaccagaacgagcagggcagcggguacgccgccgaccagaaguccacccagaacgccaucaacggcaucaccaacaaggugaacagcgucaucgagaagaugaacacccaguucacggccgugggcaaggaguucaacaagcuggagcgccggauggaguaccucaacaagaagguggacgacggguuccuggacaucuggaccuacaacgcggagcugcucguccugcuggagaacgagcgcacccucgacuuccacgacuccaacgugaagaaccuguacgagaaggucaagagccagcugaagaacaacgccaaggagaucggcuacgggugcuucgaguucuaccacaagugcaacaacgagugcauggaguccgugaagaacggcaccuacgacuacccgaaguacagcgaggagagcaagcucaaccgggagaagaucgacggggugaagcuggaguccaugggcgucuaccagauccuggccaucuacagcacgguggccuccagccucgugcugcuggucucccucggcgccaucagcuucuggaugugcuccaacgggagccugcagugccgcaucugcaucuga

SEQ ID NO: 74699 - RNA, 1689 nt, Artificial Sequence
  derived and/or modified sequence opt1 from hemagglutinin__InfluenzaA__BAC43764
auggccaucaucuaccugauccuccuguucaccgccgugcgcggcgaccagaucugcaucggguaccacgcgaacaacagcaccgagaaggucgacacgauccuggagcggaacgugaccgugacccacgccaagaacauccucgagaagacccacaacggcaagcugugcaagcugaacgggaucccgccccucgagcugggcgacugcuccaucgccggguggcugcucggcaaccccgagugcgaccgccugcugaucguccccgaguggagcuacaucauggagaaggagaacccccgggacggccucugcuacccgggguccuucaacgacuacgaggagcugaagcaccuccugagcuccgugaagcacuucgagaaggugaagauccugcccaaggaccgcuggacgcagcacaccaccaccggcgggagccgggccugcgccgucuccggcaaccccagcuucuuccgcaacaugguguggcugacgaagaagggguccaacuaccccguggcgaagggcagcuacaacaacaccuccggcgagcagaugcucaucaucuggggcguccaccacccgaucgacgagaccgagcagaucacccuguaccagaacguggggacguacgugagcgucgggaccuccacccugaacaagcggagcacccccgagaucgccacgcgccccaaggugaacggccucggcucccggauggaguucagcuggacccugcuggacaugugggacaccaucaacuucgaguccaccgggaaccucaucgcccccgaguacggcuucaagaucagcaagcgcggguccagcggcaucaugaagacggaggggacccuggagaacugcgagaccaagugccagaccccgcugggcgccaucaacacgacccuccccuuccacaacgugcacccccugaccaucggcgagugccccaaguacgucaagagcgagaagcuggugcucgcgaccgggcugcggaacgugccgcagaucgagucccgcggccuguucggggccaucgccggcuucaucgagggcggguggcagggcauggucgacgggugguacggcuaccaccacagcaacgaccagggguccggcuacgccgccgacaaggagagcacgcagaaggcguucgacgggaucaccaacaaggugaacuccgugaucgagaagaugaacacccaguucgaggccgucggcaaggaguucagcaaccucgagcggcgccuggagaaccugaacaagaagauggaggacggcuuccucgacguguggaccuacaacgccgagcugcuggugcucauggagaacgagcggacgcuggacuuccacgacuccaacgucaagaaccuguacgacaaggugcgcaugcagcuccgggacaacgucaaggagcuggggaacggcugcuucgaguucuaccacaagugcgacgacgagugcaugaacagcgugaagaacgggaccuacgacuaccccaaguacgaggaggaguccaagcugaaccgcaacgagaucaagggcgugaagcucagcuccaugggcgucuaccagauccuggccaucuacgccaccguggcggggagccugucccucgccaucaugauggccggcaucagcuucuggaugugcuccaacgggagccugcaguuccggaucugcaucuga

SEQ ID NO: 74700 - RNA, 1707 nt, Artificial Sequence
  derived and/or modified sequence opt1 from hemagglutinin__InfluenzaA__BAE07201
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgccaacgaccucugcuaccccggggacuucaacgacuacgaggagcugaagcaccuccucucccggaucaaccacuucgagaagauccagaucaucccgaagaacagcugguccagccacgaggccucccugggcgucagcuccgcgugccccuaccagggcaagagcuccuucuuccgcaacgugguguggcugaucaagaagaacaacgccuaccccaccaucaagcggagcuacaacaacacgaaccaggaggaccuccugguccugugggggauccaccaccccaacgacgccgccgagcagacccgccucuaccagaacccgaccaccuacaucuccgugggcacgagcacccugaaccagcggcuggugcccaagaucgcgacccgcuccaaggucaacgggcagaacggccggauggaguucuucuggaccauccucaagcccaacgacgccaucaacuucgagagcaacgggaacuucaucgcccccgaguacgccuacaagaucgugaagaagggcgacuccgccaucaugaaguccgagcuggaguacggcaacugcaacacgaagugccagaccccgaugggggcgaucaacagcagcaugcccuuccacaacauccacccccugaccaucggcgagugccccaaguacgucaagagcaaccgccucgugcuggccaccgggcugcggaacuccccgcagcgcgagcggcgccggaagaagcgcggccucuucggcgccaucgccggguucaucgagggcggguggcagggcaugguggacgggugguacggcuaccaccacagcaacgagcagggcuccggguacgccgcggacaaggagagcacgcagaaggccaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacgcuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcgcgccucaagcgcgaggagaucuccggggugaagcuggagagcaucggcaccuaccagauccuguccaucuacagcaccgucgccuccagccucgcccuggccaucaugguggccgggcugucccucuggaugugcagcaacggcucccugcagugccggaucugcaucuga

SEQ ID NO: 74701 - RNA, 1701 nt, Artificial Sequence
  derived and/or modified sequence opt1 from hemagglutinin__InfluenzaA__BAH95823
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaagcacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 74702 - RNA, 1701 nt, Artificial Sequence; identical to SEQ ID NO: 63664
  derived and/or modified sequence opt1 from hemagglutinin__InfluenzaA__BAH95824

SEQ ID NO: 74703 - RNA, 1707 nt, Artificial Sequence
  derived and/or modified sequence opt1 from hemagglutinin__InfluenzaA__BAJ07997
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgccaacgaccucugcuaccccggggacuucaacgacuacgaggagcugaagcaccuccucucccggaucaaccacuucgagaagauccagaucaucccgaagaacagcugguccagccacgaggccucccugggcgucagcuccgcgugccccuaccagggcaagagcuccuucuuccgcaacgugguguggcugaucaagaagaacaacgccuaccccaccaucaagcggagcuacaacaacacgaaccaggaggaccuccugguccugugggggauccaccaccccaacgacgccgccgagcagacccgccucuaccagaacccgaccaccuacaucuccgugggcacgagcacccugaaccagcggcuggugcccaagaucgcgacccgcuccaaggucaacgggcagagcggccggauggaguucuucuggaccauccucaagcccaacgacgccaucaacuucgaguccaacgggaacuucaucgcccccgaguacgccuacaagaucgugaagaagggcgacagcgccaucaugaaguccgagcuggaguacggcaacugcaacacgaagugccagaccccgaugggggcgaucaacagcagcaugcccuuccacaacauccacccccugaccaucggcgagugccccaaguacgugaaguccaaccgccucguccuggccaccgggcugcggaacagcccgcagcgcgagcggcgccggaagaagcgcggccucuucggcgccaucgccggguucaucgagggcggguggcagggcaugguggacgggugguacggcuaccaccacuccaacgagcagggcagcggguacgccgcggacaaggaguccacgcagaaggccaucgacggcgugaccaacaaggucaacagcaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacgcuggacuuccacgacuccaacgugaagaaccuguacgacaagguccggcuccagcugcgcgacaacgccaaggagcuggggaacggcugcuucgaguucuaccacaagugcgacaacgagugcauggagagcgugcggaacggcaccuacgacuacccccaguacuccgaggaggcgcgccucaagcgcgaggagaucagcggggugaagcuggaguccaucggcaccuaccagauccugagcaucuacuccaccgucgccagcucccucgcccuggccaucaugguggccgggcugagccucuggaugugcuccaacggcagccugcagugccggaucugcaucuga

SEQ ID NO: 74704 - RNA, 1701 nt, Artificial Sequence
  derived and/or modified sequence opt1 from hemagglutinin__InfluenzaA__BAJ39949
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccaagcugcuggugcuccugaagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 74705 - RNA, 1701 nt, Artificial Sequence
  derived and/or modified sequence opt1 from hemagglutinin__InfluenzaA__BAJ39950
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucgccgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 74706 - RNA, 1701 nt, Artificial Sequence
  derived and/or modified sequence opt1 from hemagglutinin__InfluenzaA__BAJ39951
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccuuccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 74707 - RNA, 1701 nt, Artificial Sequence; identical to SEQ ID NO: 70280
  derived and/or modified sequence opt1 from hemagglutinin__InfluenzaA__BAJ39952

SEQ ID NO: 74708 - RNA, 1701 nt, Artificial Sequence
  derived and/or modified sequence opt1 from hemagglutinin__InfluenzaA__BAJ39953
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccaagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 74709 - RNA, 1701 nt, Artificial Sequence; identical to SEQ ID NO: 70280
  derived and/or modified sequence opt1 from hemagglutinin__InfluenzaA__BAJ39954

SEQ ID NO: 74710 - RNA, 1701 nt, Artificial Sequence
  derived and/or modified sequence opt1 from hemagglutinin__InfluenzaA__BAJ39955
augaaggccauccuggugguccuccuguacaccuucgccaccgcgaacgccgacacgcugagcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugagcaccgcguccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaucagcgccgaccagcagucccuguaccagaacgccgacaccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugcaagaucugcaucuga

SEQ ID NO: 74711 - RNA, 1701 nt, Artificial Sequence; identical to SEQ ID NO: 74705
  derived and/or modified sequence opt1 from hemagglutinin__InfluenzaA__BAJ39956

SEQ ID NO: 74712 - RNA, 1701 nt, Artificial Sequence; identical to SEQ ID NO: 70280
  derived and/or modified sequence opt1 from hemagglutinin__InfluenzaA__BAJ39957

SEQ ID NO: 74713 - RNA, 1701 nt, Artificial Sequence
  derived and/or modified sequence opt1 from hemagglutinin__InfluenzaA__BAJ39958
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaaggucaagucccagcugaagaacaacgccaaggagaucgggaacggcugcuucgaguucuaccacaagugcgacaacacgugcauggagagcgugaagaacgggaccuacgacuaccccaaguacuccaaggaggccaagcugaaccgcgagaagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 74714 - RNA, 1701 nt, Artificial Sequence
  derived and/or modified sequence opt1 from hemagglutinin__InfluenzaA__BAJ39959
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguucauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaaggucaagagccagcugaagaacaacgccaaggagaucgggaacggcugcuucgaguucuaccacaagugcgacaacacgugcauggaguccgugaagaacgggaccuacgacuaccccaaguacagcaaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 74715 - RNA, 1701 nt, Artificial Sequence; identical to SEQ ID NO: 63677
  derived and/or modified sequence opt1 from hemagglutinin__InfluenzaA__BAJ39960

SEQ ID NO: 74716 - RNA, 1701 nt, Artificial Sequence; identical to SEQ ID NO: 64306
  derived and/or modified sequence opt1 from hemagglutinin__InfluenzaA__BAJ39961

SEQ ID NO: 74717 - RNA, 1701 nt, Artificial Sequence
  derived and/or modified sequence opt1 from hemagglutinin__InfluenzaA__BAJ39962
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucgccgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaccuggcucgucaagaaggggaacagcuaccccaagcuguccaagagcuacaucaacgacaagggcaaggaggugcuggugcucugggggauccaccaccccagcacguccgccgaccagcagagccuguaccagaacgccgacgccuacgucuucgugggcaccucccgguacagcaagaaguucaagcccgagaucgcgauccgcccgaaggugcgggaccaggagggccgcaugaacuacuacuggacccuggucgagcccggggacaagaucaccuucgaggccacgggcaaccucguggugccccgguacgccuucgccauggagcgcaacgccggguccggcaucaucaucagcgacacccccguccacgacugcaacacgaccugccagaccccgaagggcgcgaucaacaccucccugcccuuccagaacauccaccccaucaccaucgggaagugccccaaguacgucaagagcaccaagcugcggcucgccacgggccugcgcaacgugccguucauccagucccgggggcuguucggcgccaucgccggguucaucgagggcggcuggaccgggaugguggacggcugguacggguaccaccaccagaacgagcagggcagcggguacgccgcggaccucaaguccacccagaacgccaucgacgagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggucaagagccagcugaagaacaacgccaaggagaucgggaacggcugcuucgaguucuaccacaagugcgacaacacgugcauggaguccgugaagaacgggaccuacgacuaccccaaguacagcaaggaggcgaagcugaaccgcgaggagaucgacggcgugaagcucgaguccacccggaucuaccagauccuggccaucuacagcaccguggccuccagccugguccucguggugagccugggggccaucuccuucuggaugugcagcaacggcucccugcagugccgcaucugcaucuga

SEQ ID NO: 74718 - RNA, 1701 nt, Artificial Sequence; identical to SEQ ID NO: 63677
  derived and/or modified sequence opt1 from hemagglutinin__InfluenzaA__BAJ39963

SEQ ID NO: 74719 - RNA, 1701 nt, Artificial Sequence; identical to SEQ ID NO: 70280
  derived and/or modified sequence opt1 from hemagglutinin__InfluenzaA__BAJ39964

SEQ ID NO: 74720 - RNA, 1701 nt, Artificial Sequence; identical to SEQ ID NO: 63677
  derived and/or modified sequence opt1 from hemagglutinin__InfluenzaA__BAJ39965

SEQ ID NO: 74721 - RNA, 1701 nt, Artificial Sequence; identical to SEQ ID NO: 63677
  derived and/or modified sequence opt1 from hemagglutinin__InfluenzaA__BAJ39966

SEQ ID NO: 74722 - RNA, 1701 nt, Artificial Sequence
  derived and/or modified sequence opt1 from hemagglutinin__InfluenzaA__BAJ39967
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccagcugguccuacaucguggagaccagcuccagcgacaacggcacgugcuaccccggcgacuucaucgacuacgaggagcugcgggagcagcuguccagcguguccagcuucgagcgcuucgagaucuuccccaagaccuccagcuggcccaaccacgacuccgacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggcccugggcaaggaguucaaccaccucgagaagaagaucgagaaccugaacaagaagguggacgacggcuuccuggacaucuggaccuacaacgccgagcuccugguccugcucgagaacgagcgcacccuggacuaccacgacuccaacgugaagaaccuguacgagaaggugcggagccagcucaagaacaacgccaaggagaucgggaacggcugcuucgaguucuaccacaagugcgacaacacgugcauggaguccgucaagaacgggaccuacgacuaccccaaguacagcgaggaggccaagcugaaccgcgaggagaucgacggcgugaagcuggaguccacccggaucuaccagauccucgcgaucuacagcaccguggccuccagccugguccugguggugagccucggggccaucuccuucuggaugugcagcaacggcucccugcagugccgcaucugcaucuga

SEQ ID NO: 74723 - RNA, 1701 nt, Artificial Sequence; identical to SEQ ID NO: 69205
  derived and/or modified sequence opt1 from hemagglutinin__InfluenzaA__BAJ39968

SEQ ID NO: 74724 - RNA, 1701 nt, Artificial Sequence; identical to SEQ ID NO: 70280
  derived and/or modified sequence opt1 from hemagglutinin__InfluenzaA__BAJ39969

SEQ ID NO: 74725 - RNA, 1701 nt, Artificial Sequence; identical to SEQ ID NO: 63677
  derived and/or modified sequence opt1 from hemagglutinin__InfluenzaA__BAJ39970

SEQ ID NO: 74726 - RNA, 1701 nt, Artificial Sequence; identical to SEQ ID NO: 63677
  derived and/or modified sequence opt1 from hemagglutinin__InfluenzaA__BAJ39971

SEQ ID NO: 74727 - RNA, 1701 nt, Artificial Sequence; identical to SEQ ID NO: 64306
  derived and/or modified sequence opt1 from hemagglutinin__InfluenzaA__BAJ39972

SEQ ID NO: 74728 - RNA, 1701 nt, Artificial Sequence
  derived and/or modified sequence opt1 from hemagglutinin__InfluenzaA__BAJ39973
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaaggucaagucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggccaucuacuccaccgucgcgagcagccuggugcucguggucucccugggggccaucagcuucuggaugugcuccaacggcagccugcagugccgcaucugcaucuga

SEQ ID NO: 74729 - RNA, 1701 nt, Artificial Sequence; identical to SEQ ID NO: 63677
  derived and/or modified sequence opt1 from hemagglutinin__InfluenzaA__BAJ39974

SEQ ID NO: 74730 - RNA, 1701 nt, Artificial Sequence; identical to SEQ ID NO: 64246
  derived and/or modified sequence opt1 from hemagglutinin__InfluenzaA__BAJ39975

SEQ ID NO: 74731 - RNA, 1701 nt, Artificial Sequence
  derived and/or modified sequence opt1 from hemagglutinin__InfluenzaA__BAJ39976
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacgggacgugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucaacuucuggaugugcagcaacgggucccugcagugccggaucugcaucuga

SEQ ID NO: 74732 - RNA, 1701 nt, Artificial Sequence; identical to SEQ ID NO: 63677
  derived and/or modified sequence opt1 from hemagglutinin__InfluenzaA__BAJ39977

SEQ ID NO: 74733 - RNA, 1701 nt, Artificial Sequence
  derived and/or modified sequence opt1 from hemagglutinin__InfluenzaA__BAJ39978
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaaggucaagagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgcgagaagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 74734 - RNA, 1701 nt, Artificial Sequence
  derived and/or modified sequence opt1 from hemagglutinin__InfluenzaA__BAJ39979
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccagcugguccuacaucguggagaccagcuccagcgacaacggcacgugcuaccccggcgacuucaucgacuacgaggagcugcgggagcagcuguccagcguguccagcuucgagcgcuucgagaucuuccccaagaccuccagcuggcccaaccacgacuccgacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcauggacuacuacuggacccucguggagcccggggacaagaucaccuucgaggcgaccggcaaccugguggucccccgguacgccuucgccauggagcgcaacgccgggagcggcaucaucaucuccgacacgcccgugcacaacugcaacacgaccugccagaccccgaagggcgccaucaacaccagccugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggugaacagcgucaucgagaagaugaacacccaguucacggccgugggcaaggaguucaaccaccuggagaaccgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 74735 - RNA, 1701 nt, Artificial Sequence; identical to SEQ ID NO: 70280
  derived and/or modified sequence opt1 from hemagglutinin__InfluenzaA__BAJ39980

SEQ ID NO: 74736 - RNA, 1701 nt, Artificial Sequence
  derived and/or modified sequence opt1 from hemagglutinin__InfluenzaA__BAJ39981
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugcagcaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaaggucaagagccagcugaagaacaacgccaaggagaucgggaacggcugcuucgaguucuaccacaagugcgacaacacgugcauggaguccgugaagaacgggaccuacgacuacccgaaguacagcaaggaggccaagcugaaccgcgagaagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 74737 - RNA, 1701 nt, Artificial Sequence
  derived and/or modified sequence opt1 from hemagglutinin__InfluenzaA__BAJ39982
augaaggccauccuggugguccuccuguacaccuucgccaccgcgaacgccgccacgcugugcaucggcuaccacgccaacaacagcaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgcgauccgcccgaaggugcgggaccaggagggccgcaugaacuacuacuggacccucgucgagcccggggacaagaucaccuucgaggccaccggcaaccugguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcuccggcuggccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcucaaccgggaggagaucgacggcgugaagcuggagagcacccgcaucuaccagauccuggccaucuacuccaccguggccagcagccucguccugguggugucccugggggccaucagcuucuggaugugcuccaacggcagccuccagugccggaucugcaucuga

SEQ ID NO: 74738 - RNA, 1701 nt, Artificial Sequence; identical to SEQ ID NO: 74705
  derived and/or modified sequence opt1 from hemagglutinin__InfluenzaA__BAJ39983

SEQ ID NO: 74739 - RNA, 1701 nt, Artificial Sequence
  derived and/or modified sequence opt1 from hemagglutinin__InfluenzaA__BAJ39984
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccagcugguccuacaucguggagaccagcuccagcgacaacggcacgugcuaccccggcgacuucaucgacuacgaggagcugcgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacaacugcaacacgaccugccagaccccgaagggcgccaucaacaccagccugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 74740 - RNA, 1701 nt, Artificial Sequence; identical to SEQ ID NO: 63677
  derived and/or modified sequence opt1 from hemagglutinin__InfluenzaA__BAJ39985

SEQ ID NO: 74741 - RNA, 1701 nt, Artificial Sequence
  derived and/or modified sequence opt1 from hemagglutinin__InfluenzaA__BAJ39987
augaagaccauccuggugguccuccuguacaccuucgccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccaaggaggccaagcugaaccgggaggagaucgacggcgugaagcucgagagcacccgcaucuaccagauccuggccaucuacuccaccgucgccagcagccuggugcucguggucucccugggggcgaucagcuucuggaugugcuccaacggcagccugcagugccggaucugcaucuga

SEQ ID NO: 74742 - RNA, 1701 nt, Artificial Sequence
  derived and/or modified sequence opt1 from hemagglutinin__InfluenzaA__BAJ39988
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagcaucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugcagcaaguacgugaaguccaccaagcugcggcuggcgaccggccuccgcaacguccccagcauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 74743 - RNA, 1701 nt, Artificial Sequence; identical to SEQ ID NO: 64991
  derived and/or modified sequence opt1 from hemagglutinin__InfluenzaA__BAJ39989

SEQ ID NO: 74744 - RNA, 1701 nt, Artificial Sequence; identical to SEQ ID NO: 63677
  derived and/or modified sequence opt1 from hemagglutinin__InfluenzaA__BAJ39990

SEQ ID NO: 74745 - RNA, 1701 nt, Artificial Sequence; identical to SEQ ID NO: 63677
  derived and/or modified sequence opt1 from hemagglutinin__InfluenzaA__BAJ39993

SEQ ID NO: 74746 - RNA, 1701 nt, Artificial Sequence
  derived and/or modified sequence opt1 from hemagglutinin__InfluenzaA__BAJ39994
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaccaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaaggucaagucccagcugaagaacaacgccaaggagaucgggaacggcugcuucgaguucuaccacaagugcgacaacacgugccuggagagcgugaagaacgggaccuacgacuaccccaaguacuccgaggaggccaagcucaaccgcgagaagaucgacggcgugaagcuggagagcacccggaucuaccagauccuggccaucuacuccaccgucgcgagcagccucgugcugguggucucccugggggccaucagcuucuggaugugcuccaacggcagccuccagugccgcaucugcaucuga

SEQ ID NO: 74747 - RNA, 1701 nt, Artificial Sequence; identical to SEQ ID NO: 63677
  derived and/or modified sequence opt1 from hemagglutinin__InfluenzaA__BAJ39996

SEQ ID NO: 74748 - RNA, 1701 nt, Artificial Sequence
  derived and/or modified sequence opt1 from hemagglutinin__InfluenzaA__BAJ39997
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaccaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 74749 - RNA, 1701 nt, Artificial Sequence; identical to SEQ ID NO: 63677
  derived and/or modified sequence opt1 from hemagglutinin__InfluenzaA__BAJ39998

SEQ ID NO: 74750 - RNA, 1701 nt, Artificial Sequence
  derived and/or modified sequence opt1 from hemagglutinin__InfluenzaA__BAJ39999
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgcuacagcaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcgccucgccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggccaucuacuccaccgucgcgagcagccuggugcucguggucucccugggggccaucagcuucuggaugugcuccaacggcagccugcagugccgcaucugcaucuga

SEQ ID NO: 74751 - RNA, 1701 nt, Artificial Sequence
  derived and/or modified sequence opt1 from hemagglutinin__InfluenzaA__BAJ40000
augaagaccauccuggugguccuccuguacaccuucgccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgccagcagccuggugcucguggucucccugggggcgaucagcuucuggaugugcuccaacggcagccugcagugccggaucugcaucuga

SEQ ID NO: 74752 - RNA, 1701 nt, Artificial Sequence; identical to SEQ ID NO: 68687
  derived and/or modified sequence opt1 from hemagglutinin__InfluenzaA__BAJ40001

SEQ ID NO: 74753 - RNA, 1701 nt, Artificial Sequence; identical to SEQ ID NO: 63677
  derived and/or modified sequence opt1 from hemagglutinin__InfluenzaA__BAJ40002

SEQ ID NO: 74754 - RNA, 1701 nt, Artificial Sequence; identical to SEQ ID NO: 68687
  derived and/or modified sequence opt1 from hemagglutinin__InfluenzaA__BAJ40003

SEQ ID NO: 74755 - RNA, 1701 nt, Artificial Sequence
  derived and/or modified sequence opt1 from hemagglutinin__InfluenzaA__BAJ40004
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggagaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugaagucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgagaagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 74756 - RNA, 1701 nt, Artificial Sequence
  derived and/or modified sequence opt1 from hemagglutinin__InfluenzaA__BAJ40006
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggccgggaggugcugguccucugggggauccaccaccccagcaccuccgccgaccagcagagccuguaccagaacgccgacacguacguguucgugggcaccucccgcuacagcaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcgccucgccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggccaucuacuccaccgucgcgagcagccuggugcucguggucucccugggggccaucagcuucuggaugugcuccaacggcagccugcagugccgcaucugcaucuga

SEQ ID NO: 74757 - RNA, 1701 nt, Artificial Sequence; identical to SEQ ID NO: 63677
  derived and/or modified sequence opt1 from hemagglutinin__InfluenzaA__BAJ40007

SEQ ID NO: 74758 - RNA, 1701 nt, Artificial Sequence
  derived and/or modified sequence opt1 from hemagglutinin__InfluenzaA__BAJ40008
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaucgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 74759 - RNA, 1701 nt, Artificial Sequence
  derived and/or modified sequence opt1 from hemagglutinin__InfluenzaA__BAJ40009
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcgacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcauggacuacuacuggacccugguggagcccggggacaagaucaccuucgaggcgaccggcaaccucguggucccccgguacgccuucgccauggagcgcaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaaccgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 74760 - RNA, 1701 nt, Artificial Sequence
  derived and/or modified sequence opt1 from hemagglutinin__InfluenzaA__BAJ40010
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccagcugguccuacaucguggagaccagcuccagcgacaacggcacgugcuaccccggcgacuucaucgacuacgaggagcugcgggagcagcuguccagcguguccagcuucgagcgcuucgagaucuuccccaagaccuccagcuggcccaaccacgacuccgacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcauggacuacuacuggacccucguggagcccggggacaagaucaccuucgaggcgaccggcaaccugguggucccccgguacgccuucgccauggagcgcaacgccgggagcggcaucaucaucuccgacacgcccgugcacaacugcaacacgaccugccagaccccgaagggcgccaucaacaccagccugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 74761 - RNA, 1701 nt, Artificial Sequence; identical to SEQ ID NO: 74750
  derived and/or modified sequence opt1 from hemagglutinin__InfluenzaA__BAJ40011

SEQ ID NO: 74762 - RNA, 1701 nt, Artificial Sequence
  derived and/or modified sequence opt1 from hemagglutinin__InfluenzaA__BAJ40012
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcaucaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 74763 - RNA, 1701 nt, Artificial Sequence; identical to SEQ ID NO: 74750
  derived and/or modified sequence opt1 from hemagglutinin__InfluenzaA__BAJ40013

SEQ ID NO: 74764 - RNA, 1701 nt, Artificial Sequence; identical to SEQ ID NO: 74750
  derived and/or modified sequence opt1 from hemagglutinin__InfluenzaA__BAJ40014

SEQ ID NO: 74765 - RNA, 1701 nt, Artificial Sequence
  derived and/or modified sequence opt1 from hemagglutinin__InfluenzaA__BAJ40015
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaacaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 74766 - RNA, 1701 nt, Artificial Sequence; identical to SEQ ID NO: 74750
  derived and/or modified sequence opt1 from hemagglutinin__InfluenzaA__BAJ40016

SEQ ID NO: 74767 - RNA, 1701 nt, Artificial Sequence
  derived and/or modified sequence opt1 from hemagglutinin__InfluenzaA__BAJ40017
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaaggcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 74768 - RNA, 1701 nt, Artificial Sequence; identical to SEQ ID NO: 64841
  derived and/or modified sequence opt1 from hemagglutinin__InfluenzaA__BAJ40018

SEQ ID NO: 74769 - RNA, 1701 nt, Artificial Sequence; identical to SEQ ID NO: 74756
  derived and/or modified sequence opt1 from hemagglutinin__InfluenzaA__BAJ40019

SEQ ID NO: 74770 - RNA, 1701 nt, Artificial Sequence; identical to SEQ ID NO: 74756
  derived and/or modified sequence opt1 from hemagglutinin__InfluenzaA__BAJ40020

SEQ ID NO: 74771 - RNA, 1701 nt, Artificial Sequence
  derived and/or modified sequence opt1 from hemagglutinin__InfluenzaA__BAJ40021
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggagaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 74772 - RNA, 1701 nt, Artificial Sequence; identical to SEQ ID NO: 64841
  derived and/or modified sequence opt1 from hemagglutinin__InfluenzaA__BAJ40023

SEQ ID NO: 74773 - RNA, 1701 nt, Artificial Sequence
  derived and/or modified sequence opt1 from hemagglutinin__InfluenzaA__BAJ40024
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 74774 - RNA, 1701 nt, Artificial Sequence; identical to SEQ ID NO: 74750
  derived and/or modified sequence opt1 from hemagglutinin__InfluenzaA__BAJ40025

SEQ ID NO: 74775 - RNA, 1701 nt, Artificial Sequence; identical to SEQ ID NO: 64841
  derived and/or modified sequence opt1 from hemagglutinin__InfluenzaA__BAJ40026

SEQ ID NO: 74776 - RNA, 1701 nt, Artificial Sequence
  derived and/or modified sequence opt1 from hemagglutinin__InfluenzaA__BAJ40027
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggagaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugaagucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 74777 - RNA, 1701 nt, Artificial Sequence
  derived and/or modified sequence opt1 from hemagglutinin__InfluenzaA__BAJ40028
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccgccuucaucgagggcggguggacgggcaugguggacgggugguacggcuaccaccaccagaacgagcagggguccggcuacgccgcggaccucaagagcacccagaacgccaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggcgaagcugaaccgggaggagaucgacggggugaagcucgagagcacccgcaucuaccagauccuggccaucuacuccaccgucgccagcagccuggugcucguggucucccugggcgccaucagcuucuggaugugcuccaacgggagccugcagugccggaucugcaucuga

SEQ ID NO: 74778 - RNA, 1701 nt, Artificial Sequence; identical to SEQ ID NO: 74750
  derived and/or modified sequence opt1 from hemagglutinin__InfluenzaA__BAJ40029

SEQ ID NO: 74779 - RNA, 1701 nt, Artificial Sequence
  derived and/or modified sequence opt1 from hemagglutinin__InfluenzaA__BAJ40030
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcucaaggagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggccgcgaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 74780 - RNA, 1701 nt, Artificial Sequence; identical to SEQ ID NO: 63677
  derived and/or modified sequence opt1 from hemagglutinin__InfluenzaA__BAJ40031

SEQ ID NO: 74781 - RNA, 1701 nt, Artificial Sequence; identical to SEQ ID NO: 74750
  derived and/or modified sequence opt1 from hemagglutinin__InfluenzaA__BAJ40032

SEQ ID NO: 74782 - RNA, 1701 nt, Artificial Sequence; identical to SEQ ID NO: 74779
  derived and/or modified sequence opt1 from hemagglutinin__InfluenzaA__BAJ40033

SEQ ID NO: 74783 - RNA, 1701 nt, Artificial Sequence
  derived and/or modified sequence opt1 from hemagglutinin__InfluenzaA__BAJ40034
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgcuacagcaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcgccucgccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgcgagcagccuggugcucguggucucccugggggccaucagcuucuggaugugcuccaacggcagccugcagugccgcaucugcaucuga

SEQ ID NO: 74784 - RNA, 1701 nt, Artificial Sequence
  derived and/or modified sequence opt1 from hemagglutinin__InfluenzaA__BAJ40035
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaaguucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 74785 - RNA, 1701 nt, Artificial Sequence
  derived and/or modified sequence opt1 from hemagglutinin__InfluenzaA__BAJ40036
augaaggccauccuggugguccucaucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggaccaucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaaggucaagucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcagccucgugcugguggucucccugggggccaucagcuucuggaugugcuccaacggcagccuccagugccgcaucugcaucuga

SEQ ID NO: 74786 - RNA, 1701 nt, Artificial Sequence; identical to SEQ ID NO: 70280
  derived and/or modified sequence opt1 from hemagglutinin__InfluenzaA__BAJ40037

SEQ ID NO: 74787 - RNA, 1701 nt, Artificial Sequence
  derived and/or modified sequence opt1 from hemagglutinin__InfluenzaA__BAJ40038
augaaggccauccugcucgugcugcuguacaccuucgccaccgcgaacgccgacacgcucugcaucggcuaccacgccaacaacagcaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacacguacgucuucgugggcaccucccgguacagcaagaaguucaagcccgagaucgccauccgcccgaaggugcgggaccaggagggccgcaugaacuacuacuggaccaucgucgagcccggggacaagaucaccuucgaggccacgggcaaccucguggugccccgguacgcguucgccauggagcgcaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 74788 - RNA, 1701 nt, Artificial Sequence; identical to SEQ ID NO: 63677
  derived and/or modified sequence opt1 from hemagglutinin__InfluenzaA__BAJ40039

SEQ ID NO: 74789 - RNA, 1701 nt, Artificial Sequence
  derived and/or modified sequence opt1 from hemagglutinin__InfluenzaA__BAJ40040
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggccgggaggugcugguccucugggggauccaccaccccagcaccuccgccgaccagcagagccuguaccagaacgccgacacguacguguucgugggcaccucccgcuacagcaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguacggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcgccucgccacgggccugcggaacgucccgagcauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggccaucuacagcaccgucgcguccagccuggugcucguggucagccugggggccaucuccuucuggaugugcagcaacggcucccugcagugccgcaucugcaucuga

SEQ ID NO: 74790 - RNA, 1701 nt, Artificial Sequence; identical to SEQ ID NO: 70280
  derived and/or modified sequence opt1 from hemagglutinin__InfluenzaA__BAJ40041

SEQ ID NO: 74791 - RNA, 1701 nt, Artificial Sequence
  derived and/or modified sequence opt1 from hemagglutinin__InfluenzaA__BAJ40042
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcucaaggagccccugagcuccgugagcuccuucgagcgguucgagaucuuccccaagaccagcuccuggccgaaccacgacagcaacaagggggucaccgccgccugcccccacgccggcgcgaaguccuucuacaagaaccugaucuggcucgugaagaaggggaacagcuaccccaagcuguccaagagcuacaucaacgacaagggccgcgaggugcugguccucugggggauccaccaccccagcaccuccgccgaccggcagagccuguaccagaacgccgacacguacguguucgugggcaccucccgcuacagcaagaaguucaagccggagaucgccauccggcccaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacaccccggugcacgacugcaacacgaccugccagacccccaagggcgccaucaacaccucccugcccuuccagaacauccaccccaucaccaucgggaagugcccgaaguacgucaagagcaccaagcugcgccucgccacgggccugcggaacgugcccuccauccagagccgcgggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggccaucuacuccaccgucgcgagcagccuggugcucguggucucccugggggccaucagcuucuggaugugcuccaacggcagccugcagugccgcaucugcaucuga

SEQ ID NO: 74792 - RNA, 1701 nt, Artificial Sequence; identical to SEQ ID NO: 70280
  derived and/or modified sequence opt1 from hemagglutinin__InfluenzaA__BAJ40043

SEQ ID NO: 74793 - RNA, 1701 nt, Artificial Sequence
  derived and/or modified sequence opt1 from hemagglutinin__InfluenzaA__BAJ40044
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcagaaggagcagcucagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccugguggucccccgcuacgccuucgccauggagaucaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 74794 - RNA, 1701 nt, Artificial Sequence; identical to SEQ ID NO: 74756
  derived and/or modified sequence opt1 from hemagglutinin__InfluenzaA__BAJ40045

SEQ ID NO: 74795 - RNA, 1701 nt, Artificial Sequence
  derived and/or modified sequence opt1 from hemagglutinin__InfluenzaA__BAJ40046
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggcggugcaacaucgccggcuggauccuggggaacccggagugcgagagccuguccaccgcgagcuccuggagcuacaucguggagaccuccaucagcgacaacggcacgugcuaccccggcgacuucaucgacuacgaggagcucaaggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagaagaucgagaaccugaacaagaaggucgacgacggcuuccucgacaucuggaccuacaacgccaagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 74796 - RNA, 1701 nt, Artificial Sequence; identical to SEQ ID NO: 74779
  derived and/or modified sequence opt1 from hemagglutinin__InfluenzaA__BAJ40047

SEQ ID NO: 74797 - RNA, 1701 nt, Artificial Sequence; identical to SEQ ID NO: 74750
  derived and/or modified sequence opt1 from hemagglutinin__InfluenzaA__BAJ40048

SEQ ID NO: 74798 - RNA, 1701 nt, Artificial Sequence
  derived and/or modified sequence opt1 from hemagglutinin__InfluenzaA__BAJ40050
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcucaaggagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 74799 - RNA, 1701 nt, Artificial Sequence; identical to SEQ ID NO: 64841
  derived and/or modified sequence opt1 from hemagglutinin__InfluenzaA__BAJ40051

SEQ ID NO: 74800 - RNA, 1701 nt, Artificial Sequence
  derived and/or modified sequence opt1 from hemagglutinin__InfluenzaA__BAJ40052
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggccgggaggugcugguccucugggggauccaccaccccagcaccacggccgaccagcagucccuguaccagaacgccgacaccuacguguucgugggcaccagccgcuacuccaagaaguucaagcccgagaucgccauccggccgaagguccgcgaccaggagggccggaugaacuacuacuggacccugguggagcccggggacaagaucacguucgaggccaccggcaaccucguggucccccgcuacgcguucgccauggagcggaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcgccucgccaccggccugcggaacgucccgagcauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucacgaacaaggugaacagcgucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggccaucuacagcaccgucgcguccagccuggugcucguggucagccugggggccaucuccuucuggaugugcagcaacggcucccugcagugccgcaucugcaucuga

SEQ ID NO: 74801 - RNA, 1701 nt, Artificial Sequence
  derived and/or modified sequence opt1 from hemagglutinin__InfluenzaA__BAJ40053
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 74802 - RNA, 1701 nt, Artificial Sequence; identical to SEQ ID NO: 64841
  derived and/or modified sequence opt1 from hemagglutinin__InfluenzaA__BAJ40054

SEQ ID NO: 74803 - RNA, 1701 nt, Artificial Sequence
  derived and/or modified sequence opt1 from hemagglutinin__InfluenzaA__BAJ40055
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccaucugccagacgccgaagggcgccaucaacaccucccugcccuuccagaacauccaccccaucaccaucgggaagugccccaaguacgucaagagcaccaagcugcggcucgccacgggccugcgcaacgugccguccgugcagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggccagcagccuggugcucgucgugucccugggggcgaucagcuucuggaugugcuccaacggcagccugcagugccggaucugcaucuga

SEQ ID NO: 74804 - RNA, 1701 nt, Artificial Sequence
  derived and/or modified sequence opt1 from hemagglutinin__InfluenzaA__BAJ40056
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccagcugguccuacaucguggagaccagcuccagcgacaacggcacgugcuaccccggcgacuucaucgacuacgaggagcugcgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccucaucuggcaggucaagaaggggaacuccuaccccaagcugagcaaguccuacaucaacgacaagggcaaggaggugcuggugcucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccggcacgccuucgccauggagcgcaacgccgggagcggcaucaucaucuccgacacgcccgugcacaacugcaacacgaccugccagaccccgaagggcgccaucaacaccagccugcccuuccagaacauccaccccaucaccaucgggaagugccccaaguacgugaaguccccgaagcugcggcucgcgaccggccugcgcaacguccccagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccuacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 74805 - RNA, 1701 nt, Artificial Sequence
  derived and/or modified sequence opt1 from hemagglutinin__InfluenzaA__BAJ40057
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgcuacagcaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcgccucgccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacgaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggccaucuacuccaccgucgcgagcagccuggugcucguggucucccugggggccaucagcuucuggaugugcuccaacggcagccugcagugccgcaucugcaucuga

SEQ ID NO: 74806 - RNA, 1701 nt, Artificial Sequence; identical to SEQ ID NO: 70280
  derived and/or modified sequence opt1 from hemagglutinin__InfluenzaA__BAJ40058

SEQ ID NO: 74807 - RNA, 1701 nt, Artificial Sequence; identical to SEQ ID NO: 74750
  derived and/or modified sequence opt1 from hemagglutinin__InfluenzaA__BAJ40059

SEQ ID NO: 74808 - RNA, 1701 nt, Artificial Sequence; identical to SEQ ID NO: 64841
  derived and/or modified sequence opt1 from hemagglutinin__InfluenzaA__BAJ40060

SEQ ID NO: 74809 - RNA, 1701 nt, Artificial Sequence
  derived and/or modified sequence opt1 from hemagglutinin__InfluenzaA__BAJ40061
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaaggccagcuccuggcccaaccacgacagcaacaagggggucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 74810 - RNA, 1701 nt, Artificial Sequence
  derived and/or modified sequence opt1 from hemagglutinin__InfluenzaA__BAJ40062
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagaagaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggccaucuacuccaccgucgcgagcagccuggugcucguggucucccugggggccaucagcuucuggaugugcuccaacggcagccugcagugcaagaucugcaucuga

SEQ ID NO: 74811 - RNA, 1701 nt, Artificial Sequence; identical to SEQ ID NO: 74809
  derived and/or modified sequence opt1 from hemagglutinin__InfluenzaA__BAJ40063

SEQ ID NO: 74812 - RNA, 1701 nt, Artificial Sequence; identical to SEQ ID NO: 70280
  derived and/or modified sequence opt1 from hemagglutinin__InfluenzaA__BAJ40064

SEQ ID NO: 74813 - RNA, 1707 nt, Artificial Sequence
  derived and/or modified sequence opt1 from hemagglutinin__InfluenzaA__BAK23398
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgucaacgaccugugcuaccccgggaacuucaacgacuacgaggagcucaagcaccuccugucccggaucaaccacuucgagaagauccagaucuuccccaagagcuccuggagcgaccacgaggccuccagcggcguguccagcgccugcccguaccagggccgcuccagcuucuuccggaacguggucuggcuggugaagaaggacaacgccuaccccaccaucaagaaguccuacaacaacacgaaccaggaggaccugcugauccucugggggauccaccaccccaacgacgcggccgagcagacccgccuguaccagaacccgaccaccuacaucagcgugggcacguccacccugaaccagcggcucguccccaagaucgccacccgcagcaaggugaacgggcaguccggccggaucgaguucuucuggaccauccucaagagcaacgacgugaucaacuucgagagcaacgggaacuucaucgcccccgagaacgcguacaagaucgucaagaagggcgacuccacgaucaugaaguccgagcuggaguacggcaacugcaacaccaagugccagacccccaucggggccaucaacagcagcaugccguuccacaacauccacccccugaccaucggcgagugccccaaguacgugaaguccaaccgccuggugcuggccacggggcuccggaacagcccccgcggcgagcggcgccggaagaagcgcggccuguucggggccaucgccggcuucaucgagggcggguggcaggggauggucgacggcugguacggcuaccaccacuccaacgagcaggggagcggcuacgcggccgacaaggaguccacccagaaggccaucgacggggugaccaacaaggugaacagcaucaucgacaagaugaacacccaguucgaggccgucggccgggaguucaacaaccuggagcgccggaucgagaaccucaacaagaagauggaggacggguuccuggacguguggacguacaacgccgagcugcucguccugauggagaacgagcgcacccuggacuuccacgacuccaacgugaagaaccucuacgacaaggugcggcugcagcugcgcgacaacgcgaaggagcucggcaacggcugcuucgaguucuaccaccggugcgacaacgagugcauggagagcgucaagaacgggaccuacgacuacccgcaguacuccgaggaggcccgccugaagcgcgaggagaucagcggcgugaagcuggaguccaucgggaccuaccagauccucagcaucuacuccacgguggccagcucccuggcccuggccaucaugauggcgggccucuuccuguggaugugcagcaacgggagccugcagugccggaucugcaucuga

SEQ ID NO: 74814 - RNA, 1707 nt, Artificial Sequence
  derived and/or modified sequence opt1 from hemagglutinin__InfluenzaA__BAK23400
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccggggacuucaacgacuacgaggagcucaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccacaacccgaccaccuacaucagcgugggcacguccacccugaaccagcgccucgugcccaagaucgccacccggagcaaggucaacgggcaguccggccgcauggaguucuucuggaccauccugaagcccaacgacgcgaucaacuucgagagcaacgggaacuucaucgcccccgagaacgccuacaagaucgugaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcucccggcuggugcuggccacggggcuccgcaacagcccgcagggcaagucccggcgcaagaagcggggccuguucggggcgaucgccggcuucaucgagggcggguggcaggggaugguggacggcugguacggcuaccaccacagcaacgagcagggguccggcuacgccgccgacaaggagagcacccagcgcgccaucgacggggugaccaacaaggucaacuccaucaucgacaagaugaacacccaguucgaggcggugggccgggaguucaacaaccuggagcgccggaucgagaaccucaacaagaagauggaggacggguuccuggacguguggacguacaacgccgagcugcucguccugauggagaacgagcgcacccuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacagcgaggaggcccgccugaagcgggaggagaucuccggcgugaagcuggagagcaucgggaucuaccagauccucuccaucuacagcaccgucgccuccagccuggcgcuggccaucaugguggccggccucuuccuguggaugugcagcaacgggucccugcagugccgcaucugcaucuga

SEQ ID NO: 74815 - RNA, 1707 nt, Artificial Sequence
  derived and/or modified sequence opt1 from hemagglutinin__InfluenzaA__BAK23401
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugagcgagugguccuacaucguggagaagaucaaccccgccaacgaccugugcuaccccgggaacuucaacaacuacgaggagcucaagcaccuccugagccggaucaaccgcuucgagaagauccagaucauccccaaguccagcuggccggaccacgaggccucccucggcgucagcuccgccugccccuaccagggcgggcccagcuucuaccggaacgugguguggcugaucaagaagaacaacaccuaccccaucaucaagaaguccuaccacaacacgaaccaggaggaccugcucguccuguggggcauccaccacccgaacgacgaggaggagcagacccgcaucuacaagaaccccaccaccuacaucagcguggggacguccacccugaaccagcggcucgugcccaagaucgcgacccgcagcaaggucaacggccaguccgggcggguggaguucuucuggaccauccucaagagcaacgacacgaucaacuucgaguccaacggcaacuucaucgcccccgagaacgccuacaagaucgugaagaagggcgacagcaccaucaugaaguccgagcuggaguacgggaacugcaacaccaagugccagaccccgaucggcgccaucaacagcagcaugcccuuccacaacauccacccccugacgaucggggagugccccaaguacgucaaguccaaccgccuggugcuggcgaccggccuccggaacagcccgcagggcgagcgccggcgcaagaagcgggggcuguucggcgccaucgccggguucaucgagggcggguggcagggcaugguggacggcugguacggguaccaccacuccaacgagcagggcagcggguacgccgccgacaaggaguccacccagaaggcgaucgacggcgucaccaacaaggugaacagcaucaucgacaagaugaacauccaguucgaggccguggggcgcgaguucaacaaccuggagcggcgcaucgagaaccucaacaagaagauggaggacggcuuccuggacgucuggacguacaacgccgagcugcucgugcugauggagaacgagcggacccuggacuuccacgacuccaacgucaagaaccucuacgacaaggugcgccugcagcugcgggacaacgccaaggagcucggcaacgggugcuucgaguucuaccaccgcugcgacaacgagugcauggagagcgugcggaacggcaccuacgacuacccccaguacuccgaggaggcccgccugaagcgcgaggagaucagcggggucaagcuggaguccaucggcaccuaccagauccucagcaucuacuccacgguggcgagcucccuggcccuggccaucaugguggccgggcuguuccuguggaugugcagcaacggcucccugcagugccggaucugcaucuga

SEQ ID NO: 74816 - RNA, 1707 nt, Artificial Sequence
  derived and/or modified sequence opt1 from hemagglutinin__InfluenzaA__BAK23402
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcaaccacgaggccuccagcggcgucuccagcgccugcccguaccagggccgcuccagcuucuuccggaacgugguguggcugaucaagaaggacaacgcguaccccaccaucaagaucuccuacaacaacacgaaccaggaggaccugcugguccucugggggauccaccaccccaacgacgccgccgagcagacccgccuguaccagaacccgaccaccuacaucagcgugggcacguccacccugaaccagcggcucgugcccaagaucgccacccgcagcaaggucaacgggcaguccggccggauggaguucuucuggaccauccucaagagcaacgacgcgaucaacuucgagagcaacgggaacuucaucgcccccgagaacgccuacaagaucgugaagaagggcgacuccacgaucaugaaguccgagcuggaguacggcaacugcaacaccaagugccagacccccaucggggccaucaacagcagcaugccguuccacaacacccacccccugacgaucggcgagugccccaaguacgugaaguccaaccgccugguccuggccaccgggcuccggaacagcccccacggcgagcgccggcgcaagaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacgcaguucgaggcggugggccgcgaguucaacaaccuggagcggcgcaucgagaaccucaacaagaagauggaggacggguuccuggacguguggaccuacaacgccgagcugcucguccugauggagaacgagcggacccuggacuuccacgacuccaacgugaagaaccucuacgacaagguccgccugcagcugcgggacaacgccaaggagcucggcaacggcugcuucgaguucuaccaccgcugcgacaacgagugcauggagagcgugcggaacgggaccuacgacuacccgcaguacuccgaggaggcccgccugaagcgcgaggagaucagcggcgugaagcuggaguccaucgggacguaccagauccucagcaucuacuccaccgucgccagcucccuggcgcuggccaucaugguggccggccucuuccuguggaugugcagcaacgggagccugcagugccggaucugcaucuga

SEQ ID NO: 74817 - RNA, 1707 nt, Artificial Sequence
  derived and/or modified sequence opt1 from hemagglutinin__InfluenzaA__BAK23403
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcaaccacgaggccuccagcggcgucuccagcgccugcccguaccagggccgcuccagcuucuuccggaacgugguguggcugaucaagaaggacaacgcguaccccaccaucaagaucuccuacaacaacacgaaccaggaggaccugcugguccucugggggauccaccaccccaacgacgccgccgagcagacccgccuguaccagaacccgaccaccuacaucagcgugggcacguccacccugaaccagcggcucgugcccaagaucgccacccgcagcaaggucaacgggcaguccggccggauggaguucuucuggaccauccucaagagcaacgacgcgaucaacuucgagagcaacgggaacuucaucgcccccgagaacgccuacaagaucgugaagaagggcgacuccacgaucaugaaguccgagcuggaguacggcaacugcaacaccaagugccagacccccaucggggccaucaacagcagcaugccguuccacaacauccacccccugaccaucggcgagugccccaaguacgugaaguccaaccgccugguccuggccacggggcuccggaacagcccccagggcgagcgccggcgcaagaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacccaguucgaggcggugggccgcgaguucaacaaccuggagcggcgcaucgagaaccucaacaagaagauggaggacggguuccuggacguguggacguacaacgccgagcugcucguccugauggagaacgagcggacccuggacuuccacgacuccaacgugaagaaccucuacgacaagguccgccugcagcugcgggacaacgccaaggagcucggcaacggcugcuucgaguucuaccaccgcugcgacaacgagugcauggagagcgugcggaacgggaccuacgacuacccgcaguacuccgaggaggcccgccugaagcgcgaggagaucagcggcgugaagcuggaguccaucgggaccuaccagauccucagcaucuacuccacggucgccagcucccuggcgcuggccaucaugguggccggccucuuccuguggaugugcagcaacgggagccugcagugccggaucugcaucuga

SEQ ID NO: 74818 - RNA, 1707 nt, Artificial Sequence
  derived and/or modified sequence opt1 from hemagglutinin__InfluenzaA__BAK23404
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccagaacccgaccaccuacaucagcgugggcacguccacccugaaccagcgccucgugcccaagaucgccacccggagcaaggucaacgggcaguccggccgcauggaguucuucuggaccauccucaagagcaacgacgcgaucaacuucgagagcaacgggaacuucaucgcccccgagaacgccuacaagaucgugaagaagggcgacuccacgaucaugaaguccgagcuggaguacggcaacugcaacaccaagugccagacccccaucggggccaucaacagcagcaugccguuccacaacauccacccccugaccaucggcgagugccccaaguacgugaaguccaaccggcugguccuggccacggggcuccgcaacagcccccagggcgagcggcgccggaagaagcgcggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacccaguucgaggcggugggccgggaguucaacaaccuggagcgccggaucgagaaccucaacaagaagauggaggacggguuccuggacguguggacguacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccgcaguacuccgaggaggcccgccugaagcgggaggagaucagcggcgugaagcuggaguccaucgggaccuaccagauccucagcaucuacuccacggucgccagcucccuggcgcuggccaucaugguggccggccucuuccuguggaugugcagcaacgggagccugcagugccgcaucugcaucuga

SEQ ID NO: 74819 - RNA, 1707 nt, Artificial Sequence; identical to SEQ ID NO: 74818
  derived and/or modified sequence opt1 from hemagglutinin__InfluenzaA__BAK23405

SEQ ID NO: 74820 - RNA, 1707 nt, Artificial Sequence
  derived and/or modified sequence opt1 from hemagglutinin__InfluenzaA__BAK23406
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgucaacgaccugugcuaccccgggaacuucaacgacuacgaggagcucaagcaccuccugucccggaucaaccacuucgagaagauccagaucuuccccaagagcuccuggagcgaccacgaggccuccagcggcguguccagcgccugcccguaccagggccgcuccagcuucuuccggaacguggucuggcuggugaagaaggacaacgccuaccccaccaucaagaaguccuacaacaacacgaaccaggaggaccugcugauccucugggggauccaccaccccaacgacgcggccgagcagacccgccuguaccagaacccgaccaccuacaucagcgugggcacguccacccugaaccagcggcucguccccaagaucgccacccgcagcaaggugaacgggcaguccggccggaucgaguucuucuggaccauccucaagagcaacgacgugaucaacuucgagagcaacgggaacuucaucgcccccgagaacgcguacaagaucgucaagaagggcgacuccacgaucaugaaguccgagcuggaguacggcaacugcaacaccaagugccagacccccaucggggccaucaacagcagcaugccguuccacaacauccacccccugaccaucggcgagugccccaaguacgugaaguccaaccgccuggugcuggccacggggcuccggaacagcccccagggcgagcgccggcgcaagaagcggggccuguucggggccaucgccggcuucaucgagggcggguggcaggggauggucgacggcugguacggcuaccaccacuccaacgagcaggggagcggcuacgcggccgacaaggaguccacccagaaggccaucgacggggugaccaacaaggugaacagcaucaucgacaagaugaacacccaguucgaggccgucggccgcgaguucaacaaccuggagcggcgcaucgagaaccucaacaagaagauggaggacggguuccuggacguguggacguacaacgccgagcugcucguccugauggagaacgagcggacccuggacuuccacgacuccaacgugaagaaccucuacgacaaggugcgccugcagcugcgggacaacgcgaaggagcucggcaacggcugcuucgaguucuaccaccgcugcgacaacgagugcauggagagcgucaagaacgggaccuacgacuacccgcaguacuccgaggaggcccggcugaagcgcgaggagaucagcggcgugaagcuggaguccaucgggaccuaccagauccucagcaucuacuccacgguggccagcucccuggcccuggccaucaugauggcgggccucuuccuguggaugugcagcaacgggagccugcagugccgcaucugcaucuga

SEQ ID NO: 74821 - RNA, 1707 nt, Artificial Sequence
  derived and/or modified sequence opt1 from hemagglutinin__InfluenzaA__BAK23407
auggagaagaucgugcugcuccuggccaucgucagccuggugaaguccggccagaucugcaucggguaccacgccaacaacagcaccgagcaggucgacaccaucauggagaagaacgugacggugacccacgcgcaggacauccucgagaagacccacaacggcaagcugugcgaccuggacggggugaagccccucauccugcgcgacugcuccgucgccggcuggcugcucgggaacccgaugugcgacgaguuccugaacgugagcgagugguccuacaucguggagaagaucaaccccgccaacgaccugugcuaccccggcaacuucaacaacuacgaggagcucaagcaccuccugagccggaucaaccgcuucgagaagauccagaucauccccaaguccagcuggccggaccacgaggccucccugggcgucagcgccgcgugccccuaccagggcgggcccuccuucuaccggaacgugguguggcugaucaagaagaacaacaccuaccccacgaucgagaaguccuaccacaacaccaaccaggaggaccugcucguccugugggggauccaccacccgaacgacgaggccgagcagacccgcaucuacaagaaccccaccacguacaucagcgugggcaccagcacccugaaccagcggcucgugcccaagaucgccacccgcuccaaggucaacgggcagagcggccggguggaguucuucuggacgauccugaaguccaacgacaccaucaacuucgagagcaacggcaacuucaucgcccccgagaacgcguacaagaucgugaagaagggggacuccaccaucaugaaguccgagcuggaguacggcaacugcaacacccgcugccagacgccgaucggggccaucaacagcagcaugcccuuccacaacauccacccccucaccaucggcgagugccccaaguacgucaagagcaaccggcuggugcuggccaccggccuccgcaacuccccgcagggggagcggcgccggaagaagcgcggccuguucggggccaucgccggcuucaucgagggcggguggcagggcaugguggacgggugguacggcuaccaccacagcaacgagcagggguccggcuacgcggccgacaaggagagcacccagaaggccaucgacggggucacgaacaaggugaacuccaucaucgacaagaugaacacccaguucgaggccgugggccgggaguucaacaaccuggagcgccggaucgagaaccucaacaagaagauggaggacggcuuccuggacgucuggaccuacaacgccgagcugcucgugcugauggagaacgagcgcacccuggacuuccacgacagcaacgucaagaaccucuacgacaaggugcggcugcagcugcgcgacaacgcgaaggagcucgggaacggcugcuucgaguucuaccaccggugcgacaacgagugcauggaguccgugcgcaacgggacguacgacuacccccaguacagcgaggaggcccgccugaagcgggaggagaucuccggcgucaagcuggagagcaucgggaccuaccagauccucuccaucuacagcaccguggccuccagccuggcccuggccaucaugguggcgggccucuuccuguggaugugcuccaacggcagccugcagugccgcaucugcaucuga

SEQ ID NO: 74822 - RNA, 1707 nt, Artificial Sequence
  derived and/or modified sequence opt1 from hemagglutinin__InfluenzaA__BAK23408
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccccaacgugagcgagugguccuacaucguggagaagaucaaccccgccaacgaccugugcuaccccgggaacuucaacaacuacgaggagcugaagcaccuccugagccggaucaaccgcuucgagaagauccagaucaucccgaaguccagcuggcccgaccacgaggccucccugggcgucagcuccgccugccaguaccagggcgggcccagcuucuaccggaacgugguguggcucaucaagaaggacaacgcguaccccaccaucaagaaguccuaccacaacacgaacaaggaggaccugcugguccucuggggcauccaccacccgaacaacgaggaggagcagaccaagcuguaccagaaccccaccaccuacaucagcguggggacguccacccugaaccagcgccucgugcccaagaucgccacccggagcaaggucaacggccaguccgggcgcguggaguucuucuggaccauccucaagagcaacgacgccaucaacuucgaguccaacggcaacuucaucgcccccgagaacgcguacaagaucgugaagaagggcgacagcacgaucaugaaguccgagcuggaguacgggaacuacaacaccaagugccagaccccgaucggcgccaucaacagcagcaugcccuuccacaacauccacccccucaccaucggggagugccccaaguacgucaaguccaaccggcuggugcuggccacgggccuccgcaacagcccgcagggcgagcggcgccggaagaagcgcgggcuguucggcgccaucgccggguucaucgagggcggguggcagggcaugguggacggcugguacggguaccaccacuccaacgagcagggcagcggguacgcggccgacaaggaguccacccagaaggccaucgacggcgucaccaacaaggugaacagcaucaucgacaagaugaacacccaguucgaggccguggggaaggaguucaacaaccuggagcggcgcaucgagaaccucaacaagaagauggaggacggcuuccuggacgucuggacguacaacgccgagcugcucgugcugauggagaacgagcggacccuggacuuccacgacuccaacgucaagaaccucuacgacaaggugcgccugcagcugcgggacaacgcgaaggagcucggcaacgggugcuucgaguucuaccaccgcugcgacaacgagugcauggagagcgugcggaacggcaccuacgacuacccccaguacuccgaggaggcccgccugaagcgggaggagaucagcggggucaagcuggaguccaucggcaccuaccagauccucagcaucuacuccacgguggccagcucccuggcccuggccaucaugguggcggggcuguuccuguggaugugcagcaacggcucccugcagugccgcaucugcaucuga

SEQ ID NO: 74823 - RNA, 1707 nt, Artificial Sequence
  derived and/or modified sequence opt1 from hemagglutinin__InfluenzaA__BAK23411
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugagcgagugguccuacaucguggagaagaucaaccccgccaacgaccugugcuaccccgggaacuucaacaacuacgaggagcucaagcaccuccugagccggaucaaccgcuucgagaagauccagaucauccccaaguccagcuggccggaccacgaggccucccugggcgucagcuccgccugccaguaccagggcgggcccagcuucuaccggaacgugguguggcugaucaagaaggacaacgcguaccccaccaucaagaaguccuaccacaacacgaacaaggaggaccugcucguccuguggggcauccaccaccccaacaacgaggaggagcagaccaagcuguaccagaacccgaccaccuacaucagcguggggacguccacccucaaccagcgccuggugcccaagaucgccacccggagcaaggucaacggccaguccgggcgcguggaguucuucuggaccauccucaagagcaacgacgccaucaacuucgaguccaacggcaacuucaucgcccccgagaacgcguacaagaucgugaagaagggcgacagcacgaucaugaaguccgagcuggaguacgggaacugcaacaccaagugccagacccccaucggcgccaucaacagcagcaugccguuccacaacauccacccccugaccaucggggagugccccaaguacgucaaguccaaccggcuggugcucgccacgggccugcgcaacagcccccagggcgagcggcgccggaagaagcgcgggcuguucggcgccaucgccggguucaucgagggcggguggcagggcaugguggacggcugguacggguaccaccacuccaacgagcagggcagcggguacgcggccgacaaggaguccacccagaaggccaucgacggcgucaccaacaaggugaacagcaucaucgacaagaugaacacccaguucgaggccguggggaaggaguucaacaaccucgagcggcgcaucgagaaccugaacaagaagauggaggacggcuuccuggacgucuggacguacaacgccgagcuccuggugcugauggagaacgagcggacccucgacuuccacgacuccaacgucaagaaccuguacgacaaggugcgccugcagcuccgggacaacgcgaaggagcugggcaacgggugcuucgaguucuaccaccgcugcgacaacgagugcauggagagcgugcggaacggcaccuacgacuacccgcaguacuccgaggaggcccgccugaagcgggaggagaucagcggggucaagcucgaguccaucggcaccuaccagauccugagcaucuacuccacgguggccagcucccuggcccucgccaucaugguggcggggcuguuccuguggaugugcagcaacggcucccuccagugccgcaucugcaucuga

SEQ ID NO: 74824 - RNA, 1707 nt, Artificial Sequence
  derived and/or modified sequence opt1 from hemagglutinin__InfluenzaA__BAK23412
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaaggggaagcugugcgaccuggacggcgugaagccccucauccugcgcgacugcuccgucgccggguggcugcucggcaacccgaugugcgacgaguuccugaacgugagcgagugguccuacaucguggagaagaucaaccccgccaacgaccugugcuaccccgggaacuucaacaacuacgaggagcucaagcaccuccugagccggaucaaccgcuucgagaagauccagaucauccccaaguccagcuggccggaccacgaggccucccugggcgucagcuccgccugccaguaccagggcgggcccagcuucuaccggaacgugguguggcugaucaagaaggacaacaccuaccccacgaucaagaaguccuaccacaacaccaacaaggaggaccugcucguccuguggggcauccaccaccccaacaacgaggaggagcagaccaagcuguaccagaacccgaccacguacaucagcguggggaccuccacccucaaccagcgccuggugcccaagaucgcgacccggagcaaggucaacggccaguccgggcgcguggaguucuucuggacgauccucaagagcaacgacgccaucaacuucgaguccaacggcaacuucaucgcccccgagaacgccuacaagaucgugaagaagggcgacagcaccaucaugaaguccgagcuggaguacgggaacugcaacaccaagugccagacccccaucggcgcgaucaacagcagcaugccguuccacaacauccacccccugacgaucggggagugccccaaguacgucaaguccaaccggcuggugcucgccaccggccugcgcaacagcccccagggcgagcggcgccggaagaagcgcgggcuguucggcgccaucgccggguucaucgagggcggguggcagggcaugguggacggcugguacggguaccaccacuccaacgagcagggcagcggguacgccgcggacaaggaguccacccagaaggccaucgacggcgucaccaacaaggugaacagcaucaucgacaagaugaacacgcaguucgaggccguggggaaggaguucaacaaccucgagcggcgcaucgagaaccugaacaagaagauggaggacggcuuccuggacgucuggaccuacaacgccgagcuccuggugcugauggagaacgagcggacccucgacuuccacgacuccaacgucaagaaccuguacgacaaggugcgccugcagcuccgggacaacgccaaggagcugggcaacgggugcuucgaguucuaccaccgcugcgacaacgagugcauggagagcgugcggaacggcaccuacgacuacccgcaguacuccgaggaggcgcgccugaagcgggaggagaucagcggggucaagcucgaguccacgggcaccuaccagauccugagcaucuacuccaccguggccagcucccuggcccucgccaucaugguggccgggcuguuccuguggaugugcagcaacggcucccuccagugccgcaucugcaucuga

SEQ ID NO: 74825 - RNA, 1707 nt, Artificial Sequence
  derived and/or modified sequence opt1 from hemagglutinin__InfluenzaA__BAK23413
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugagcgagugguccuacaucguggagaagaucaaccccgccaacgaccugugcuaccccgggaacuucaacaacuacgaggagcucaagcaccuccugagccggaucaaccgcuucgagaagauccagaucauccccaaguccagcuggccggaccacgaggccucccugggcgucagcuccgccugccaguaccagggcgggcccagcuucuaccggaacgugguguggcugaucaagaaggacaacaccuaccccacgaucaagaaguccuaccacaacaccaacaaggaggaccugcucguccuguggggcauccaccaccccaacaacgaggaggagcagaccaagcuguaccagaacccgaccacguacaucagcguggggaccuccacccucaaccagcgccuggugcccaagaucgcgacccggagcaaggucaacggccaguccgggcgcguggaguucuucuggacgauccucaagagcaacgacgccaucaacuucgaguccaacggcaacuucaucgcccccgagaacgccuacaagaucgugaagaagggcgacagcaccaucaugaaguccgagcuggaguacgggaacugcaacaccaagugccagacccccaucggcgcgaucaacagcagcaugccguuccacaacauccacccccugacgaucggggagugccccaaguacgucaaguccaaccggcuggugcucgccaccggccugcgcaacagcccccagggcgagcggcgccggaagaagcgcgggcuguucggcgccaucgccggguucaucgagggcggguggcagggcaugguggacggcugguacggguaccaccacuccaacgagcagggcagcggguacgccgcggacaaggaguccacccagaaggccaucgacggcgucaccaacaaggugaacagcaucaucgacaagaugaacacgcaguucgaggccguggggaaggaguucaacaaccucgagcggcgcaucgagaaccugaacaagaagauggaggacggcuuccuggacgucuggaccuacaacgccgagcuccuggugcugauggagaacgagcggacccucgacuuccacgacuccaacgucaagaaccuguacgacaaggugcgccugcagcuccgggacaacgccaaggagcugggcaacgggugcuucgaguucuaccaccgcugcgacaacgagugcauggagagcgugcggaacggcaccuacgacuacccgcaguacuccgaggaggcgcgccugaagcgggaggagaucagcggggucaagcucgaguccaucggcacguaccagauccugagcaucuacuccaccguggccagcucccuggcccucgccaucaugguggccgggcuguuccuguggaugugcagcaacggcucccuccagugccgcaucugcaucuga

SEQ ID NO: 74826 - RNA, 1707 nt, Artificial Sequence; identical to SEQ ID NO: 74823
  derived and/or modified sequence opt1 from hemagglutinin__InfluenzaA__BAK23414

SEQ ID NO: 74827 - RNA, 1698 nt, Artificial Sequence
  derived and/or modified sequence opt1 from hemagglutinin__InfluenzaA__BAM65746
auggaggugaagcugcucguccugcugugcaccuucaccgccacguacgccgacaccaucugcaucggcuaccacgcgaacaacagcaccgacaccguggacacgcuccccgagaagaacgugaccgucacccacuccgugaaccugcuggaggacacccacaacgggaagcucugccugcugaagggcaucgccccgcuccagcuggggaacugcagcguggccggcuggauccuggggaaccccgagugcgagcuccugaucucccgcgagagcugguccuacaucgucgagaagcccaaccccgagaacggcaucugcuacccgggccacuucgccgacuacgaggagcugcgggagcagcucagcuccgugagcuccuucgagcgcuucgagaucuuccccaaggagagcuccuggcccaaccacacggccaccggggugagcgcguccugcagccacaacggcaaguccagcuucuacaagaaccugcuguggcucaccgucaagaacgggcuguaccccaaccuguccaagagcuacgccaacaacaaggagaaggaggugcucgugcuguggggcguccaccacccgaccaacaucggggaccagcgggcccuguaccacacggagaacgccuacguguccguggucagcagccacuacucccgccgguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaagagcaacgcgcccauggacgagugcaacgccaagugccagacgccccagggcgccaucaacuccagccugcccuuccagaacgugcacccggucaccaucggggagugccccaaguacgugcgguccaccaagcugcgcauggugaccggccuccggaacacgcccagcauccagucccgcgggcuguucggcgccaucgccggguucaucgagggcggcuggaccgggauggucgacggcugguacggguaccaccaccagaacgagcagggcagcggguacgcggccgaccagaaguccacccagaacgccaucaacggcaucaccaacaaggugaacagcgugaucgagaagaugaacacgcaguucaccgccgucgacaaggaguucaacaagcuggagcggcgcauggagaacuucaacaagaagguggacgacggcuucaucgacaucuggaccuacaacgccgagcuccugauccugcucgagaacgagcggacccuggacuuccacgacuccaacgucaagaaccuguacgagaaggucaagagccagcucaagaacaacgcgaaggagaucgggaacggcugcuucgaguucuaccacaagugcaacgacgagugcauggaguccgugaagaacgggacguacgacuaccccaaguacagcgaggaguccaagcugaaccgcgagaagaucgacggcgugaagcuggagagcauggggguguaccagauccucgccaucuacuccaccguggccagcagcaugguccugcuggugucccucggcgccaucagcuucuggaugugcuccaacggcagccugcagugccggaucugcaucuga

SEQ ID NO: 74828 - RNA, 1701 nt, Artificial Sequence; identical to SEQ ID NO: 73574
  derived and/or modified sequence opt1 from hemagglutinin__InfluenzaA__BAO79716

SEQ ID NO: 74829 - RNA, 1683 nt, Artificial Sequence
  derived and/or modified sequence opt1 from Hemagglutinin__InfluenzaA__CAB95856
auggagaccaucagccugaucaccauccuccugguggucacggccuccaacgccgacaagaucugcaucggccaccagagcaccaacuccaccgagaccguggacacgcugaccgagaccaacgugcccgucacccacgcgaaggagcuccugcacacggagcacaacgggaugcugugcgccaccagccucggccacccgcugauccuggacacgugcaccaucgaggggcucguguacggcaaccccuccugcgaccugcugcucgggggccgcgaguggagcuacaucguggagcgguccagcgccgucaacgggaccugcuaccccggcaacguggagaaccuggaggagcugcgcacccucuucuccagcgccuccagcuaccagcggauccagaucuuccccgacaccaccuggaacgugacguacaccggcaccucccgcgccugcagcggguccuucuaccggagcaugcgcuggcugacccagaaguccggcuucuacccgguccaggacgcgcaguacacgaacaaccggggcaagagcauccuguucgugugggggauccaccacccgcccaccuacaccgagcagaccaaccucuacauccgcaacgacacgaccaccuccgugaccacggaggaccugaaccggaccuucaagcccgucaucggcccccgcccccuggugaacgggcuccagggccggaucgacuacuacuggagcgugcugaagcccgggcagacccugcgcguccggagcaacggcaaccucaucgcccccugguacggccacgugcuguccgggggcagccacgggcgcauccugaagaccgaccucaagggcgggaacugcgugguccagugccagacggagaagggcggccugaacuccacccugccguuccacaacaucagcaaguacgccuucgggaccugccccaaguacgugcgggugaacucccucaagcuggccgucggccugcgcaacgugcccgcgcggagcucccgcggccucuucggggccaucgccggguucaucgagggcggcuggcccgggcugguggccggcugguacggguuccagcacagcaacgaccagggcgucgggauggccgcggaccgggacuccacccagaaggccaucgacaagaucacgagcaaggugaacaacaucgucgacaagaugaacaagcaguacgagaucaucgaccacgaguucuccgagguggagacccgccugaacaugaucaacaacaagaucgacgaccagauccaggacgugugggccuacaacgccgagcuccugguccugcucgagaaccagaagacccuggacgagcacgacgccaacgugaacaaccuguacaacaaggugaagcgggcgcucggcagcaacgccauggaggacggcaaggggugcuucgagcuguaccacaagugcgacgaccagugcauggagaccauccgcaacggcaccuacaaccgccggaaguaccgcgaggagucccggcuggagcgccagaagaucgagggggucaagcucgagagcgagggcacguacaagauccugaccaucuacuccaccguggccagcucccuggugcucgccaugggcuucgccgcguuccuguucugggccaugagcaacggguccugccggugcaacaucugcaucuga

SEQ ID NO: 74830 - RNA, 1683 nt, Artificial Sequence
  derived and/or modified sequence opt1 from Hemagglutinin__InfluenzaA__CAB95857
auggagaccaucagccugaucaccauccuccugguggucacggccuccaacgccgacaagaucugcaucggccaccagagcaccaacuccaccgagaccguggacacgcugaccgagaccaacgugcccgucacccacgcgaaggagcuccugcacacggagcacaacgggaugcugugcgccaccagccucggccacccgcugauccuggacacgugcaccaucgaggggcucguguacggcaaccccuccugcgaccugcugcucgaggggcgcgaguggagcuacaucguggagcgguccagcgccgucaacgggaccugcuaccccggcaacguggagaaccuggaggagcugcgcacccucuucuccagcgccuccagcuaccagcggauccagaucuuccccgacaccaccuggaacgugacguacaccggcaccucccgcgccugcagcggcuccuucuaccggagcaugcgcuggcugacccagaaguccggguucuacccgguccaggacgcgcaguacacgaacaaccggggcaagagcauccuguucgugugggggauccaccacccgcccaccuacaccgagcagaccaaccucuacauccgcaacgacacgaccaccuccgugaccacggaggaccugaaccggaccuucaagcccgucaucggcccccgcccccuggugaacggccuccaggggcggaucgacuacuacuggagcgugcugaagcccggccagacccugcgcguccggagcaacgggaaccucaucgcccccugguacggccacgugcuguccggcgggagccacggccgcauccugaagaccgaccucaaguccgggaacugcgugguccagugccagacggagaagggcgggcugaacagcacccugccguuccacaacaucuccaaguacgccuucgggaccugccccaaguacgugcgggugaacagccucaagcuggccgucggccugcgcaacgugcccgcgcgguccagccgcggccucuucggcgccaucgccggguucaucgagggcggguggcccggccugguggccggcugguacggguuccagcacuccaacgaccagggcgucgggauggccgcggaccgggacagcacccagaaggccaucgacaagaucacguccaaggugaacaacaucgucgacaagaugaacaagcaguacgagaucaucgaccacgaguucagcgagguggagacccgccugaacaugaucaacaacaagaucgacgaccagauccaggacgugugggccuacaacgccgagcuccugguccugcucgagaaccagaagacccuggacgagcacgacgccaacgugaacaaccuguacaacaaggugaagcgggcgcucggcuccaacgccauggaggacgggaagggcugcuucgagcuguaccacaagugcgacgaccagugcauggagaccauccgcaacggcaccuacaaccgccggaaguaccgcgaggagagccggcuggagcgccagaagaucgagggggucaagcucgaguccgagggcgccuacaagauccugacgaucuacagcaccguggccuccagccuggugcucgccaugggguucgcggccuuccuguucugggccauguccaacggcagcugccggugcaacaucugcaucuga

SEQ ID NO: 74831 - RNA, 1707 nt, Artificial Sequence
  derived and/or modified sequence opt1 from hemagglutinin__InfluenzaA__CBW54815
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccccaacgugagcgagugguccuacaucguggagaagaccaaccccgccaacgaccugugcuaccccgggaacuucgacaacuacgaggagcugaagcaccuccugagccggaucaaccgcuucgagaagauccagaucaucccgaaguccagcuggcccgaccacgaggccucccugggcgucagcuccgccugccccuaccagggcgggcccagcuucuaccggaacgugguguggcucaucaagaagaacaacacguacccgaccaucaaggaguccuaccacaacaccaaccaggaggaccugcugguccucuggggcauccaccaccccaacgacgaggaggagcagacccgcaucuacaagaaccccacgaccuacaucagcguggggaccuccacccugaaccagcggcuggugcccaagaucgcgacgcgcagcaaggucaacggccaguccgggcggguggaguucuucuggaccauccucaagagcaacgacaccaucaacuucgaguccaacggcaacuucaucgccccggagaacgccuacaagaucgugaagaagggcgacagcaccaucaugaaguccgagcuggaguacgggaacugcuccacgaagugccagacccccaucggcgccaucaacagcuccaugcccuuccacaacauccacccccugaccaucggggagugcccgaaguacgucaagagcaaccgccucgugcuggcgaccggccugcggaacagcccccagggcgaggggcgccggaagaagcgcggccucuucggggccaucgccggcuucaucgagggcggguggcagggcaugguggacgggugguacggcuaccaccacagcaacgagcagggguccggcuacgccgccgacaaggagagcacgcagaaggcgaucgacggggucaccaacaaggugaacuccaucaucgacaagaugaacacccaguucgaggccgugggccgggaguucaacaaccuggagaagcgcaucgagaaccugaacaagaagauggaggacggcuuccucgacgucuggaccuacaacgccgagcugcuggugcucauggagaacgagcggacgcuggacuuccacgacagcaacgucaagaaccuguacgacaaggugcgccuccagcugcgggacaacgccaaggagcuggggaacggcugcuucgaguucuaccaccgcugcgacaacgagugcauggaguccgugcggaacgggaccuacgacuacccccaguacagcgaggaggcccgccucaagcgggaggagaucuccggcgucaagcuggagagcaucgggaccuaccagauccuguccaucuacagcaccguggcguccagccucgcccuggccaucaugguggccggccuguuccucuggaugugcuccaacggcagccugcagugccgcaucugcaucuga

SEQ ID NO: 74832 - RNA, 1707 nt, Artificial Sequence
  derived and/or modified sequence opt1 from hemagglutinin__InfluenzaA__CBW54817
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccccaacgugagcgagugguccuacaucguggagaagaucaaccccgccaacgaccugugcuaccccgggaacuucaacaacuacgaggagcugaagcaccuccugagccggaucaaccgcuucgagaagauccagaucaucccgaaguccagcuggcccgaccacgaggccucccugggcgucagcuccgccugccccuaccagcggggccccagcuucuaccgcaacgugguguggcucaucaagaagaacgacaccuacccgacgaucaaggaguccuaccacaacaccaaccaggaggaccugcugguccucugggggauccaccaccccaacgacgaggaggagcagaagcggaucuacaagaaccccaccaccuacaucagcgugggcacguccacccugaaccagcgccuggugcccaagaucgcgacccggagcaaggucaacgggcaguccggccgcguggaguucuucuggaccauccucaagagcaacgacacgaucaacuucgaguccaacgggaacuucaucgccccggagaacgccuacaagaucgugaagaagggcgacagcaccaucaugaaguccgagcuggaguacggcaacugcagcaccaagugccagacccccaucggggccaucaacacgagcaugcccuuccacaacauccacccccugaccaucggcgagugcccgaaguacgucaaguccaaccggcucgugcuggcgaccgggcugcgcaacagcccccagggcgagggccggcgcaagaagcggggccucuucggggccaucgccggguucaucgagggcggguggcagggcaugguggacggcugguacggguaccaccacuccaacgagcagggcagcggguacgccgccgacaaggaguccacccagaaggcgaucgacggcgucacgaacaaggugaacagcaucaucgacaagaugaacacccaguucgaggccguggggcgcgaguucaacaaccuggagaagcggaucgagaaccugaacaagaagauggaggacggcuuccucgacgucuggaccuacaacgccgagcugcuggugcucauggagaacgagcgcacccuggacuuccacgacuccaacguccggaaccuguacgacaaggugcgccuccagcugcgggacaacgccaaggagcugggcaacgggugcuucgaguucuaccaccgcugcgacaacgagugcauggagagcgugcggaacggcacguacgacuacccccaguacuccgaggaggcccgccucaagcgcgaggagaucagcggggucaagcuggaguccaucggcaccuaccagauccugagcaucuacuccaccguggcgagcucccucgcccuggccaucaugguggccgggcuguuccucuggaugugcagcaacggcucccugcagugccggaucugcaucuga

SEQ ID NO: 74833 - RNA, 1707 nt, Artificial Sequence
  derived and/or modified sequence opt1 from hemagglutinin__InfluenzaA__CBW54818
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccccaacgugagcgagugguccuacaucguggagaagaccaaccccgccaacgaccugugcuaccccgggaacuucaacaacuacgaggagcugaagcaccuccugagccggaucaaccgcuucgagaagaucaagaucaucccgaaguccagcuggcccgaccacgaggccucccugggcgucagcuccgccugccccuaccagggcgggcccagcuucuaccggaacgugguguggcucaucaagaagaacaacacguacccgaccaucaaggaguccuaccacaacaccaaccaggaggaccugcugguccucuggggcauccaccaccccaacgacgaggaggagcagacccgcaucuacaagaaccccacgaccuacaucagcguggggaccuccacccugaaccagcggcuggugcccaagaucgcgacgcgcagcaaggucaacggccaguccgggcggguggaguucuucuggaccauccucaagagcaacgacaccaucaacuucgaguccaacggcaacuucaucgccccggagaacgccuacaagaucgugaagaagggcgacagcaccaucaugaaguccgagcuggaguacgggaacugcuccacgaagugccagacccccgucggcgccaucaacagcuccaugcccuuccacaacauccacccccugaccaucggggagugcccgaaguacgucaagagcaaccgccucgugcuggcgaccggccugcggaacagcccccagggcgaggggcgccggaagaagcgcggccucuucggggccaucgccggcuucaucgagggcggguggcagggcaugguggacgggugguacggcuaccaccacagcaacgagcagggguccggcuacgccgccgaccgggagagcacgcagaaggcgaucgacggggugaccaacaaggugaacuccaucaucgacaagaugaacacccaguucgaggccgucggccgcgaguucaacaaccuggagaagcggaucgagaaccugaacaagaagauggaggacggcuuccucgacguguggaccuacaacgccgagcugcugguccucauggagaacgagcgcacgcuggacuuccacgacagcaacgugaagaaccuguacgacaaggugcggcuccagcugcgcgacaacgccaaggagcuggggaacggcugcuucgaguucuaccaccggugcgacaacgagugcauggaguccguccgcaacgggaccuacgacuacccccaguacagcgaggaggcccggcucaagcgcgaggagaucuccggcgugaagcuggagagcaucgggaccuaccagauccuguccaucuacagcaccguggcguccagccucgcccuggccaucaucgucgccggccugcuccuguggaugugcuccaacggcagccugcagugccgcaucugcaucuga

SEQ ID NO: 74834 - RNA, 1701 nt, Artificial Sequence
  derived and/or modified sequence opt1 from hemagglutinin__InfluenzaA__CCG47908
augaagaccgugaucgcccugagcuacgucuucugccucggcuucgggcagggccugcccgggaagggcaacaacaccgccacgcugugccucgggcaccacgcggugccgaacggcacccuggugaagaccaucaccgacgaccagaucgaggucacgaacgccaccgagcuggugcagaacuucuccaugggcaagaucugcaagaacccccaccgcauccucgacggggccaacugcacccugaucgacagccugcucggcgacccccacugcgacggguuccaggacgagaagugggaccuguucaucgagcgguccaaggccuucagcaacugcuaccccuacgacgugccggaguacaccucccugcgcagcaucaucgccuccagcggcacgcucgaguucaccaacgaggacuucaacuggaccggggucacccagaacggcggcuccagcgcgugcaagcgggggcccaacaacuccuucuucagccgccugaacuggcuguacaaguccggcaacacguaccccaugcucaacgugaccaugcccaacagcgacgacuucgacaagcuguacaucuggggcgugcaccacccguccaccgaccgggagcagaccaaccuguacauccaggccagcgggaagaucaucgucuccacgaagcgcagccagcagaccaucauccccaacaucggcucccggcccugggugcgcgggcucagcagccggaucuccaucuacuggaccaucgugaagcccggcgacauccugaucaucaacagcaacgggaaccugaucgccccgcgcggcuacuucaagauccagaccgggaaguccagcgucaugcgguccgacgcccccaucgacacgugcaacagcgagugcaucacccccaacggcuccauccccaacgacaagccguuccagaacgugaaccgcaucaccuacggcgcgugccccaaguacaucaagcagaacacccucaagcuggccacggggaugcggaacauccccgagcgccagacccggggcaucuucggggccaucgccggcuucaucgagaacgggugggagggcauggugaacggcugguacggguuccgccaccagaacagcgagggcaucgggcaggccgcggaccugaaguccacccaggccgccaucaaccagaucaacggcaagcucaaccgggucaucgagaagaccaacgagaaguuccaccagaucgagaaggaguucagcgagguggaggggcgcauccaggaccuggagcgguacguggaggacacgaagaucgaccugugguccuacaacgccgagcuccuggucgcccuggagaaccagcacaccaucgaccucaccgacagcgagaugaacaagcuguucgagaagacccgcaagcagcugcgggagaacgcggaggacaugggcaacggcugcuucaagaucuaccacaagugcgacaacuccugcauggagagcauccgcaacgggacguacgaccacaacgaguaccgcgacgaggccgugaacaaccgguuccagaucaaguccguggagcucaagagcggcuacaaggacuggauccuguggaucuccuucgccaucagcugcuuccugcucugcgccgucuggcugggguucaucaucugggccugccagaagggcaacauccgcugcaacaucugcaucuga

SEQ ID NO: 74835 - RNA, 1701 nt, Artificial Sequence
  derived and/or modified sequence opt1 from hemagglutinin_precursor_(high_yield_phenotype)__InfluenzaA_ _AAB39851
augaaggccauccugcucgugcugcugugcaccuucgccgcgaccaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugggcgggaucgcgccccuccaccugggcaagugcaacaucgccgggcggcugcucggcaacccggagugcgagcugcugcucaccgugagcuccuggagcuacaucgucgagaccuccaagagcgacaacggcacgugcuaccccggggacuucaucaacuacgaggagcugcgcgagcagcuguccagcguguccagcuucgagcgguucgagaucuuccccaagaccuccagcuggcccaaccacgagaccaaccgcggcgugaccgccgccugcccguacgccggggccaacuccuucuaccggaaccucaucuggcuggucaagaaggagaacagcuaccccaagcuguccaagagcuacgugaacaacaagggcaaggaggugcucguccugugggggauccaccacccgcccacguccaccgaccagcagagccuguaccagaacgcggacgccuacguguucgugggcuccagcaaguacaaccgcaaguucaagcccgagaucgccgcccggcccaagguccgcggccaggccgggcggaugagcuacuacuggacccucaucgagcccggcgacaccaucacguucgaggcgaccgggaaccugguggugccccgcuacgccuucgccaugaaccggggcuccggcagcgggaucaucaucugggacgccccgguccacgacugcaacaccaagugccagacccccaagggcgccaucaacacgucccugcccuuccagaacauccaccccgugaccaucggggagugcccgaaguacgucaagagcaccaagcuccgcauggcgaccggccugcggaacgugcccuccauccagagccgcgggcuguucggcgccaucgccggcuucaucgagggcggguggacggggaugaucgacggcugguacggguaccaccaccagaacgagcagggcuccggcuacgccgccgaccagcggagcacccagaacgcgaucgacgggaucaccaacaaggugaacuccgugaucgagaagaugaacacccaguucacggccgucggcaaggaguucaaccaccucgagaagcgcaucgagaaccugaacaagaagguggacgacggguuccuggacaucuggaccuacaacgccgagcuccugguccugcucgagaacgagcggacccuggacuuccacgacagcaacgugaagaaccuguacgagaaggugcgcucccagcuccggaacaacgccaaggagaucggcaacgggugcuucgaguucuaccacaagugcgacgacacgugcauggagagcgucaagaacggcaccuacgacuaccccaaguacuccgaggagagcaagcugaaccgcgaggagaucgacggcgugaagcuggaguccacccggaucuaccagauccucgccaucuacagcaccguggcguccagccugguccugcucgugucccugggggccaucagcuucuggaugugcagcaacggcucccugcagugccgcaucugcaucuga

SEQ ID NO: 74836 - RNA, 1701 nt, Artificial Sequence
  derived and/or modified sequence opt1 from hemagglutinin_precursor__InfluenzaA__AAA43178
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcauccaccacccgagcaccaaccaggagcagaccucccuguacgugcaggccagcgggcgggugaccgucuccacgcgccggagccagcagaccaucauccccaacaucggcagccgccccugggugcggggccuguccagccgcaucuccaucuacuggaccaucgugaagcccggggacguccucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgugaacaagaucaccuacggcgccugccccaaguacgucaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggugaucgagaagacgaacgagaaguuccaccagaucgagaaggaguucagcgaggucgagggccgcauccaggaccuggagaaguacguggaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggagauggggaacggcugcuucaagaucuaccacaagugcgacaacgccugcaucgaguccauccgcaacggcaccuacgaccacgacgucuaccgcgacgaggcccucaacaaccgguuccagaucaaggggguggagcucaagagcggcuacaaggacuggauccuguggaucuccuucgcgaucagcugcuuccugcugugcgucgugcugcucggguucaucaugugggccugccagcgcggcaacauccggugcaacaucugcaucuga

SEQ ID NO: 74837 - RNA, 1689 nt, Artificial Sequence
  derived and/or modified sequence opt1 from hemagglutinin_precursor__InfluenzaA__AAA43185
auggccaucaucuaccugauccuccuguucaccgccgugcgcggcgaccagaucugcaucggguaccacgcgaacaacagcaccgagaaggucgacacgaaccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaaggaggggagcgacuaccccguggcgaagggcuccuacaacaacaccagcggcgagcagaugcucaucaucuggggcguccaccacccgaucgacgagaccgagcagcggacccuguaccagaacguggggacguacguguccgucgggaccagcacccugaacaagcgcuccacccccgagaucgccacgcggcccaaggugaacggccagggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucgagaacugcgagaccaagugccagaccccgcugggcgccaucaacacgacccugcccuuccacaacgugcacccccucaccaucggggagugccccaaguacgucaagagcgagaagcuggugcuggcgaccggccuccgcaacgugccgcagaucgagucccgggggcuguucggcgccaucgccggguucaucgagggcggcuggcaggggauggucgacggcugguacggguaccaccacagcaacgaccagggcuccggguacgccgccgacaaggagagcacgcagaaggcguucgacggcaucaccaacaaggugaacuccgugaucgagaagaugaacacccaguucgaggccgucggcaaggaguucgggaaccuggagcgccggcucgagaaccugaacaagcgcauggaggacggcuuccuggacguguggaccuacaacgccgagcuccuggugcugauggagaacgagcggacgcucgacuuccacgacagcaacgucaagaaccuguacgacaaggugcgcaugcagcugcgggacaacgucaaggagcucgggaacggcugcuucgaguucuaccacaagugcgacgacgagugcaugaacuccgugaagaacggcaccuacgacuaccccaaguacgaggaggagagcaagcugaaccgcaacgagaucaagggggugaagcuguccagcaugggcgucuaccagauccucgccaucuacgccaccguggcggggucccugagccuggccaucaugauggccggcaucuccuucuggaugugcagcaacgggucccuccagugccggaucugcaucuga

SEQ ID NO: 74838 - RNA, 1701 nt, Artificial Sequence
  derived and/or modified sequence opt1 from hemagglutinin_precursor__InfluenzaA__AAA43187
augaagaccaucaucgcccugagccacaucuucugccucgugcugggccaguaccugcccgggaacgacaacuccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcagccuggucgcguccagcgggacccuggaguucaucaccgagggcuucaccuggacgggggugacccagaacggcggguccaacgccugcaagcggggccccggcagcggguucuucucccgccucaacuggcugaccaagagcgaguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacgccaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgcgcaugcggaacgugcccgagaagcagacccgcggccuguucggcgccaucgcgggguucaucgagaacggcugggaggggaugaucgacggcugguacggguuccggcaccagaacagcgagggcaccggccaggccgccgaccugaaguccacccaggccgccaucgaccagaucaacgggaagcucaaccgcgucaucgagaagacgaacgagaaguuccaccagaucgagaaggaguucagcgagguggagggccggauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcgccggcagcugcgcgagaacgccgaggacauggggaacggcugcuucaagaucuacgacaagugcgacaacgccugcaucgaguccauccgcaacgggaccuacgaccacgacguguaccgggacgaggcccucaacaaccgcuuccagaucaagggcgucgagcucaagagcggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 74839 - RNA, 1698 nt, Artificial Sequence
  derived and/or modified sequence opt1 from hemagglutinin_precursor__InfluenzaA__AAA43209
augaaggccaagcugcucgugcugcuguacgccuucgucgcgaccgacgccgacaccaucugcaucggcuaccacgccaacaacagcacggacaccguggacaccaucuucgagaagaacguggccgucacccacuccgugaaccuccuggaggaccgccacaacgggaagcugugcaagcucaagggcaucgcgccccugcagcuggggaagugcaacaucacgggcuggcuccuggggaacccggagugcgacagccugcuccccgcccgguccuggagcuacaucguggagacccccaacuccgagaacggcgccugcuaccccggcgacuucaucgacuacgaggagcugcgcgagcagcugagcuccgucagcucccucgagcgguucgagaucuucccgaaggagagcuccuggcccaaccacaccuucaacggggugaccgugagcugcucccaccgcggcaagagcuccuucuaccggaaccugcuguggcucacgaagaagggggacagcuaccccaagcugaccaacuccuacgucaacaacaagggcaaggaggugcuggugcucuggggcguccaccaccccagcuccagcgacgagcagcagagccuguacuccaacgggaacgccuacgugagcguggccuccagcaacuacaaccgccgguucaccccggagaucgcggcccgccccaaggucaaggaccagcacggccggaugaacuacuacuggacccugcucgagcccggggacacgaucaucuucgaggccaccggcaaccugaucgcccccugguacgccuucgcgcugucccgcggguucgagagcggcaucaucaccuccaacgccagcaugcacgagugcaacaccaagugccagacgccgcagggcuccaucaacagcaaccuccccuuccagaacauccaccccgugaccaucggggagugccccaaguacgugcgguccaccaagcugcgcauggucaccggccugcggaacaucccgagcauccaguaccgcggccucuucggggccaucgccggguucaucgagggcggcuggacggggaugaucgacggcugguacggguaccaccaccagaacgagcagggcuccggguacgccgcggaccagaaguccacccagaacgccaucaacggcaucaccaacaaggugaacagcgugaucgagaagaugaacacccaguucacggccgucggcaaggaguucaacaaccuggagaagcggauggagaaccugaacaagaagguggacgacggguuccucgacaucuggaccuacaacgccgagcugcuggugcuccuggagaacgagcgcacccuggacuuccacgaccucaacgucaagaaccuguacgagaaggucaagagccagcugaagaacaacgccaaggagaucggcaacgggugcuucgaguucuaccacaagugcgacaacgagugcauggaguccgugcggaacggcaccuacgacuaccccaaguacagcgaggaguccaagcucaaccgcgagaagaucgacggggugaagcuggagagcaugggcguguaccagauccuggcgaucuacagcacggucgccuccagccucgugcugcuggugucccucggcgccaucagcuucuggaugugcuccaacgggagccugcagugccggaucugcaucuga

SEQ ID NO: 74840 - RNA, 1683 nt, Artificial Sequence
  derived and/or modified sequence opt1 from hemagglutinin_precursor__InfluenzaA__AAC40998
augaacacccagauccugauccucgcccugguggccaucauccccaccaacgcggacaagaucugccugggccaccacgccgucagcaacggggccaaggugaacacgcucaccgagcgcggcguggaggucgugaacgccaccgagaccguggagcggacgaacgucccgcgcaucugcuccaaggggaagcggaccguggaccugggccagugcgggcugcucggcaccaucaccggcccgccccagugcgaccaguuccuggaguucagcgccgaccugaucaucgagcgccgggaggggaacgacgugugcuaccccggcaaguucgucaacgaggaggcgcuccgccagauccugcggaaguccgggggcaucgacaaggagacgaugggguucaccuacagcggcauccgcaccaacggcgccaccuccgccugccggcgcagcggguccagcuucuacgccgagaugaaguggcugcucuccaacacggacaacgcggccuucccccagaugaccaagagcuacaagaacauccggaaggaccccgcccugaucaucuggggcauccaccacuccgggagcaccgccgagcagaccaagcuguacggcuccggcaacaagcucaucacgguggggagcuccaacuaccagcagagcuucgugcccucccccggcgcccgcccgcaggucaacgggcagagcggccggaucgacuuccacuggcugaugcugaaccccaacgacaccgugaccuucuccuucaacggggcguucaucgcccccgaccgcgccagcuuccuccggggcaagagcaugggcauccaguccgaggugcaggucgacgccaacugcgagggggacugcuaccacagcggcgggaccauccuguccagccugcccuuccagaacaucaacucccgcacggugggcgagugcccgcgguacgugaagcaggagagccuccugcuggccaccgggaugaagaacguccccgagauccccaagggccgcggccucuucggggcgaucgccggcuucaucgagaacgggugggagggccugguggacgggugguacggcuuccggcaccagaacgcccagggcgaggggaccgccgccgacuacaaguccacccagagcgcgaucgaccagaucacgggcaagcugaaccgccucaucgagaagaccaaccagcaguucgagcugaucgacaacgaguucaccgagguggagaagcagaucgggaacgucaucaacuggacccgggacucccugacggagauguggagcuacaacgccgagcuccugguggccauggagaaccagcacaccaucgaccuggccgacuccgagaugaacaagcucuacgagcgcgugcgccggcagcugcgcgagaacgccgaggaggacggcaccggcugcuucgagaucuuccacaagugcgacgacgacugcauggcgagcauccggaacaacaccuacgaccacuccaaguaccgcgaggaggccauccagaaccggauccagaucgaccccgucaagcugagcuccggguacaaggacgugauccucugguucagcuucggcgccuccugcuucauccugcuggccaucgcgauggggcucgucuucaucugcgugaagaacggcaacaugcgcugcacgaucugcaucuga

SEQ ID NO: 74841 - RNA, 1683 nt, Artificial Sequence
  derived and/or modified sequence opt1 from hemagglutinin_precursor__InfluenzaA__AAC40999
augaacacccagauccugauccucgcccugguggccaucauccccaccaacgcggacaagaucugccugggccaccacgccgucagcaacgggacgaaggugaacacccucaccgagcgcggcguggaggucgugaacgccaccgagacgguggagcggaccaacgucccgcgcaucugcuccaaggggaagcggaccguggaccugggccagugcgggcugcucggcaccaucacgggcccgccccagugcgaccaguuccuggaguucagcgccgaccugaucaucgagcgccgggagggggacgacgugugcuaccccggcaaguucgucaacgaggaggcccuccgccagauccugcgggaguccgggggcaucgacaaggagaccaugggguucaccuacagcggcauccgcaccaacggcgcgacguccgccugccggcgcagcggguccagcuucuacgccgagaugaaguggcugcucuccaacaccgacaacgccgcguucccccagaugaccaagagcuacaagaacauccggaaggaccccgcccugaucaucuggggcauccaccacuccgggagcaccgccgagcagacgaagcuguacggcuccggcaacaagcucaucaccguggggagcuccaacuaccagcagagcuucgugcccauccccggcgcccgcccgcaggucaacgggcaguccggccggaucgacuuccacuggcugaugcugaaccccaacgacaccgugaccuucagcuucaacggggccuucaucgcgcccgaccgcgccuccuuccuccggggcaagagcaugggcauccagagcgaggugcaggucgacgccaacugcgagggggacugcuaccacuccggcgggacgauccugaacaaccugcccuuccagaacaucaacggccgcgccguggggaagugcccgcgguacgugaagcaggagagccuccugcuggccaccggcaugaagaacguccccgagauccccaagggccgcggccucuucggggcgaucgccggguucaucgagaacggcugggaggggcugguggacggcugguacggcuuccggcaccagaacgcccagggggagggcaccgccgccgacuacaaguccacccagagcgcgaucgaccagaucacggggaagcugaaccgccucaucgagaagaccaaccagcaguucgagcugaucgacaacgaguucaccgagguggagaagcagaucggcaacgucaucaacuggacccgggacuccaugacggagguguggagcuacaacgccgagcugcucguggccauggagaaccagcacaccaucgaccuggccgacuccgagaugaacaagcuguacgagcgcguccgccggcagcuccgcgagaacgccgaggaggacggcaccgggugcuucgagaucuuccacaagugcgacgacgacugcauggcgagcauccggaacaacaccuacgaccacuccaaguaccgcgaggaggccauccagaaccggauccagaucgaccccgugaagcugagcuccggcuacaaggacgucauccugugguucagcuucggggccuccugcuucauccuccuggccaucgcgaugggccugguguucaucugcgugaagaacgggaacaugcgcugcacgaucugcaucuga

SEQ ID NO: 74842 - RNA, 1698 nt, Artificial Sequence; identical to SEQ ID NO: 63496
  derived and/or modified sequence opt1 from hemagglutinin__InfluenzaA__ACA28844

SEQ ID NO: 74843 - RNA, 1698 nt, Artificial Sequence; identical to SEQ ID NO: 68801
  derived and/or modified sequence opt1 from hemagglutinin__InfluenzaA__ACA28844/m1

SEQ ID NO: 74844 - RNA, 1701 nt, Artificial Sequence; identical to SEQ ID NO: 70158
  derived and/or modified sequence opt1 from hemagglutinin__InfluenzaA__ACV82259

SEQ ID NO: 74845 - RNA, 1701 nt, Artificial Sequence; identical to SEQ ID NO: 70158
  derived and/or modified sequence opt1 from hemagglutinin__InfluenzaA__ACV82259/m1

SEQ ID NO: 74846 - RNA, 1701 nt, Artificial Sequence; identical to SEQ ID NO: 70158
  derived and/or modified sequence opt1 from hemagglutinin__InfluenzaA__ACV82259/m2

SEQ ID NO: 74847 - RNA, 1701 nt, Artificial Sequence; identical to SEQ ID NO: 63675
  derived and/or modified sequence opt1 from hemagglutinin__InfluenzaA__ACP41953

SEQ ID NO: 74848 - RNA, 1701 nt, Artificial Sequence; identical to SEQ ID NO: 73249
  derived and/or modified sequence opt1 from hemagglutinin__InfluenzaA__AFM72832

SEQ ID NO: 74849 - RNA, 1701 nt, Artificial Sequence
  derived and/or modified sequence opt1 from hemagglutinin__InfluenzaA__EPI516528
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacaccccggugcacgacugcaacacgaccugccagacccccaagggcgccaucaacaccucccugcccuuccagaacauccaccccaucacgaucgggaagugcccgaaguacgucaagagcaccaagcugcggcucgcgaccggccugcgcaacauccccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcacugccggaucugcgucuga

SEQ ID NO: 74850 - RNA, 1701 nt, Artificial Sequence
  derived and/or modified sequence opt1 from hemagglutinin__InfluenzaA__AGM53850
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccacccgcccaccagcgccgaccagcagagccuguaccagaacgccgacgccuacguguucgugggcuccagccgguacuccaagaaguucaagcccgagaucgccauccgccccaagguccgggaccaggagggccgcaugaacuacuacuggacgcugguggagcccggggacaagaucaccuucgaggcgaccggcaaccucguggucccgcgguacgccuucgccauggagcgcaacgccgggagcggcaucaucaucuccgacacccccgugcacgacugcaacacgaccugccagacccccaagggcgccaucaacaccagccugcccuuccagaacauccacccgaucacgaucgggaagugccccaaguacgugaaguccaccaagcugcggcucgcgaccggccugcgcaacauccccagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 74851 - RNA, 1701 nt, Artificial Sequence
  derived and/or modified sequence opt1 from hemagglutinin__InfluenzaA__EPI731463
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaacaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagccggagaucgccauccgccccaagguccggggccaggaggggcgcaugaacuacuacuggacgcugguggagcccggcgacaagaucaccuucgaggcgaccgggaaccucguggucccccgguacgccuucgccauggagcgcaacgccggcuccggcaucaucaucagcgacaccccggugcacgacugcaacacgaccugccagacccccaagggggccaucaacaccucccugcccuuccagaacauccaccccaucacgaucggcaagugcccgaaguacgucaagagcaccaagcugcggcucgcgaccgggcugcgcaacauccccuccauccagagccggggccuguucggggccaucgccggcuucaucgagggcggguggaccggcaugguggacgggugguacggcuaccaccaccagaacgagcagggguccggcuacgccgccgaccucaagagcacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccguggccagcagccugguccucguggugucccugggcgccaucagcuucuggaugugcuccaacggcagccugcagugccggaucugcaucuga

SEQ ID NO: 74852 - RNA, 1701 nt, Artificial Sequence; identical to SEQ ID NO: 65506
  derived and/or modified sequence opt1 from hemagglutinin__InfluenzaA__EPI696972

SEQ ID NO: 74853 - RNA, 1701 nt, Artificial Sequence; identical to SEQ ID NO: 74694
  derived and/or modified sequence opt1 from hemagglutinin__InfluenzaA__EPI662594

SEQ ID NO: 74854 - RNA, 1701 nt, Artificial Sequence
  derived and/or modified sequence opt1 from hemagglutinin__InfluenzaA__EPI685579
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 74855 - RNA, 1701 nt, Artificial Sequence
  derived and/or modified sequence opt1 from hemagglutinin__InfluenzaA__EPI830230
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccacgaccgcggaccagcagagccuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagagcacccggaucuaccagauccuggccaucuacuccaccgucgccagcucccuggugcucguggucagccugggggcgaucuccuucuggaugugcagcaacggcagccugcagugccgcaucugcaucuga

SEQ ID NO: 74856 - RNA, 1701 nt, Artificial Sequence; identical to SEQ ID NO: 63664
  derived and/or modified sequence opt1 from hemagglutinin__InfluenzaA__ACQ45338

SEQ ID NO: 74857 - RNA, 1701 nt, Artificial Sequence; identical to SEQ ID NO: 63664
  derived and/or modified sequence opt1 from hemagglutinin__InfluenzaA__ACQ45338/m1

SEQ ID NO: 74858 - RNA, 1701 nt, Artificial Sequence; identical to SEQ ID NO: 63664
  derived and/or modified sequence opt1 from hemagglutinin__InfluenzaA__ACQ45338/m2

SEQ ID NO: 74859 - RNA, 1701 nt, Artificial Sequence; identical to SEQ ID NO: 63326
  derived and/or modified sequence opt1 from hemagglutinin__InfluenzaA__ACU79871

SEQ ID NO: 74860 - RNA, 1701 nt, Artificial Sequence
  derived and/or modified sequence opt1 from hemagglutinin__InfluenzaA__ACU79871/m1
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucgagagccgccccugggugcggggccaguccagccgcaucuccaucuacuggaccaucgucaagcccggcgacgugcuggugaucaacagcaacgggaaccucaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcuggccacgggcaugcgcaacgugcccgagaagcagacccggggccucuucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaaggucaaccggaucaucgagaagacgaacgagaaguuccaccagaucgagaaggaguucagcgagguggaggggcgcauccaggaccuggagaaguacguggaggacaccaagaucgaccucugguccuacaacgcggagcugcuggucgcccucgagaaccagcacaccaucgaccugaccgacagcgagaugaacaagcuguucgagaagacgcggcgccagcuccgggagaacgccgaggacaugggcaacgggugcuucaagaucuaccacaagugcgacaacgccugcaucgaguccauccgcagcggcaccuacgaccacgacguguaccgcgacgaggcccugaacaaccgguuccagaucaagggcgucgagcugaaguccggguacaaggacuggauccucuggaucagcuucgcgaucuccugcuuccugcugugcguggugcuccugggcuucaucaugugggccugccagcgcgggaacauccggugcaacaucugcaucuga

SEQ ID NO: 74861 - RNA, 1701 nt, Artificial Sequence
  derived and/or modified sequence opt1 from hemagglutinin__InfluenzaA__EPI643118
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacauccccucccggaucagcaucuacuggaccaucgucaagccgggcgacauccuccugaucaacuccacggggaaccugaucgcgccccgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggccacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 74862 - RNA, 1701 nt, Artificial Sequence; identical to SEQ ID NO: 73449
  derived and/or modified sequence opt1 from hemagglutinin__InfluenzaA__EPI675798

SEQ ID NO: 74863 - RNA, 1701 nt, Artificial Sequence
  derived and/or modified sequence opt1 from hemagglutinin__InfluenzaA__EPI578430
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcuccugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcagcgggcgcaucaccguguccaccaagcggagccagcaggccgugauccccaacaucggcucccgcccccggauccgcgacauccccagccggaucuccaucuacuggacgaucgucaagccgggcgacauccuccugaucaacagcaccgggaaccugaucgcgccccgcggcuacuucaagauccgguccggcaagagcuccaucaugcgcagcgacgcccccaucgggaagugcaaguccgagugcaucacccccaacggcagcaucccgaacgacaagcccuuccagaacgugaaccggaucaccuacggggccugcccccgcuacgugaagcacuccacgcucaagcuggccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcucaaccggcugaucggcaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcugugcguggcccuccugggcuucaucaugugggccugccagaaggggaacauccgcugcaacaucugcaucuga

SEQ ID NO: 74864 - RNA, 1701 nt, Artificial Sequence
  derived and/or modified sequence opt1 from hemagglutinin__InfluenzaA__EPI614406
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcuccugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcagcgggcgcaucaccguguccaccaagcggagccagcaggccgugauccccaacaucggcucccgcccccggauccgcaacauccccagccggaucuccaucuacuggacgaucgucaagccgggcgacauccuccugaucaacagcaccgggaaccugaucgcgccccgcggcuacuucaagauccgguccggcaagagcuccaucaugcgcagcgacgcccccaucgggaagugcaaguccgagugcaucacccccaacggcagcaucccgaacgacaagcccuuccagaacgugaaccggaucaccuacggggccugcccccgcuacgugaagcacuccacgcucaagcuggccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcucaaccggcugaucggcaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcugugcguggcccuccugggcuucaucaugugggccugccagaaggggaacauccgcugcaacaucugcaucuga

SEQ ID NO: 74865 - RNA, 1695 nt, Artificial Sequence
  derived and/or modified sequence opt1 from hemagglutinin__InfluenzaA__ACU65077/m1
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagagcgugcgcaacggcacguacgacuacccccaguacuccgaggaggcccggcucaagcgcgaggagaucagcggggucaagcuggaguccaucggcaucuaccagauccugagcaucuacuccaccguggccagcucccucgcccuggcgaucaugguggccgggcugagccucuggaugugcagcaacggcucccugcagugccggaucugcaucuga

SEQ ID NO: 74866 - RNA, 1695 nt, Artificial Sequence; identical to SEQ ID NO: 74865
  derived and/or modified sequence opt1 from hemagglutinin__InfluenzaA__ACU65077/m2

SEQ ID NO: 74867 - RNA, 1707 nt, Artificial Sequence; identical to SEQ ID NO: 61036
  derived and/or modified sequence opt1 from hemagglutinin__InfluenzaA__ABP51976

SEQ ID NO: 74868 - RNA, 1707 nt, Artificial Sequence; identical to SEQ ID NO: 61036
  derived and/or modified sequence opt1 from hemagglutinin__InfluenzaA__ABP51976/m1

SEQ ID NO: 74869 - RNA, 1695 nt, Artificial Sequence
  derived and/or modified sequence opt1 from hemagglutinin__InfluenzaA__ABW90125
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuacugguccagccacgaggccucccugggcgugagcuccgccugcccguaccagggcaagagcuccuucuuccgcaacguggucuggcugaccaagaagaacagcaccuaccccacgaucaagcgguccuacaacaacaccaaccaggaggaccuccuggugcugugggggauccaccaccccaacgacgcggccgagcagaccaagcucuaccagaacccgaccacguacaucagcgugggcaccuccacccugaaccagcgccuggucccccggaucgccacccgcagcaaggugaacgggcaguccggccggauggaguucuucuggacgauccucaagcccaacgacgccaucaacuucgagagcaacgggaacuucaucgcgcccgaguacgccuacaagaucgugaagaagggcgacagcaccaucaugaaguccgagcuggaguacggcaacugcaacaccaagugccagaccccgaugggggccaucaacagcuccaugcccuuccacaacauccacccccugacgaucggcgagugccccaaguacgucaagagcaaccgccucgugcuggccaccgggcugcggaacuccccgcagcgcgagacccggggccucuucggcgccaucgcgggguucaucgagggcggguggcagggcaugguggacgggugguacggcuaccaccacagcaacgagcagggcuccggguacgccgccgacaaggagagcacccagaaggccaucgacggcgucacgaacaaggugaacuccaucaucgacaagaugaacacccaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacagcaacgucaagaaccuguacgacaaggugcgccuccagcugcgggacaacgccaaggagcuggggaacggcugcuucgaguucuaccacaagugcgacaacgagugcauggaguccgugcgcaacggcacguacgacuacccccaguacagcgaggaggcccggcucaagcgcgaggagaucuccggggucaagcuggagagcaucggcaucuaccagauccuguccaucuacagcaccguggccuccagccucgcccuggcgaucaugguggccgggcugucccucuggaugugcagcaacggcagccugcagugccggaucugcaucuga

SEQ ID NO: 74870 - RNA, 1695 nt, Artificial Sequence
  derived and/or modified sequence opt1 from hemagglutinin__InfluenzaA__ABW90126
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccaccaucaaggggagcuacaacaacacgaaccaggaggaccuccuggugcuguggggcauccaccaccccaacgacgcggccgagcagaccaagcucuaccagaacccgaccaccuacaucuccguggggacgagcacccugaaccagcggcuggucccccgcaucgccacccgguccaaggugaacggccagagcgggcgcauggaguucuucuggaccauccucaagcccaacgacgccaucaacuucgagagcaacggcaacuucaucgcgcccgaguacgccuacaagaucgugaagaagggcgacuccacgaucaugaaguccgagcuggaguacgggaacugcaacaccaagugccagaccccgaugggcgccaucaacagcagcaugcccuuccacaacauccacccccugaccaucggggagugccccaaguacgucaaguccaaccggcucgugcuggccacgggccugcgcaacagcccgcagcgggagacccgcggccucuucggggccaucgcgggcuucaucgagggcggguggcaggggaugguggacggcugguacggcuaccaccacuccaacgagcaggggagcggcuacgccgccgacaaggaguccacccagaaggccaucgacggggucaccaacaaggugaacagcaucaucgacaagaugaacacgcaguucgaggccgugggccgggaguucaacaaccuggagcgccggaucgagaaccugaacaagaagauggaggacggguuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcugggcaacggcugcuucgaguucuaccacaagugcgacaacgagugcauggagagcgugcggaacgggaccuacgacuacccccaguacuccgaggaggcccgccucaagcgggaggagaucagcggcgucaagcuggaguccaucgggaucuaccagauccugagcaucuacuccacgguggccagcucccucgcccuggcgaucaugguggccggccugagccucuggaugugcagcaacgggucccugcagugccgcaucugcaucuga

SEQ ID NO: 74871 - RNA, 1695 nt, Artificial Sequence
  derived and/or modified sequence opt1 from hemagglutinin__InfluenzaA__ABW90127
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcgaguccagcuucuuccgcaacguggucuggcugaucaagaagaacuccaccuaccccaccaucaagcggagcuacaacaacacgaaccaggaggaccuccuggugcugugggggauccaccaccccaacgacgcggccgagcagaccaagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgagagcaacgggaacuucaucgcgcccgaguacgccuacaagaucgugaagaagggcgacuccacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacagcccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagagcgugcgcaacggcaccuacgacuacccccaguacuccgaggaggcccggcucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcaucuga

SEQ ID NO: 74872 - RNA, 1695 nt, Artificial Sequence
  derived and/or modified sequence opt1 from hemagglutinin__InfluenzaA__ABW90128
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucgagaagaacuccaccuaccccaccaucaagcggagcuacaacaacacgaaccaggaggaccuccuggugcugugggggauccaccaccccaacgacgcggccgagcagaccaagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgagagcaacgggaacuucaucgcgcccgaguacgccuacaagaucgugaagaagggcgacuccacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacagcccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagagcgugcgcaacggcaccuacgacuacccccaguacuccgaggaggcccggcucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcaucuga

SEQ ID NO: 74873 - RNA, 1695 nt, Artificial Sequence
  derived and/or modified sequence opt1 from hemagglutinin__InfluenzaA__ABW90129
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccgcguaccccaccaucaagcggagcuacaacaacaccaaccaggaggaccuccuggugcugugggggauccaccaccccaacgacgccgccgagcagacggagcucuaccagaacccgaccaccuacaucuccgugggcaccagcacgcugaaccagcgccuggucccccggaucgccacccgcuccaaggugaacgggcagagcggccggauggaguucuucuggaccauccucaagcccaacgacgcgaucaacuucgagagcaacgggaacuucaucgcccccgaguacgccuacaagaucgugaagaagggcgacuccaccaucaugaaguccgagcuggaguacggcaacugcaacacgaagugccagaccccgaugggggccaucaacagcagcaugcccuuccacaacauccacccccugaccaucggcgagugccccaaguacgucaaguccaaccgccucgugcuggccaccgggcugcggaacagcccgcagcgcgagacgcggggccucuucggcgcgaucgccggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacccaguucgaggcgguggggcgcgaguucaacaaccuggagcggcgcaucgagaaccugaacaagaagauggaggacggcuuccucgacgucuggacguacaacgccgagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagagcgugcgcaacggcaccuacgacuacccccaguacuccgaggaggcccggcucaagcgcgaggagaucagcggggucaagcuggaguccaucggcaucuaccagauccugagcaucuacuccaccguggccagcucccucgcgcuggccaucaugguggccgggcugagccucuggaugugcagcaacggcucccugcagugccggaucugcaucuga

SEQ ID NO: 74874 - RNA, 1695 nt, Artificial Sequence
  derived and/or modified sequence opt1 from hemagglutinin__InfluenzaA__ABW90130
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguucuccuucuuccgcaacguggucuggcugaucaagaagaacagcaccuaccccaccaucaagcgguccuacaacaacacgaaccaggaggaccuccuggugcugugggggauccaccaccccaacgacgcggccgagcagaccaagcucuaccagaacccgaccaccuacaucagcgugggcacguccacccugaaccagcgccuggucccccggaucgccacccgcagcaaggugaacgggcaguccggccggauggaguucuucuggaccauccucaagcccaacgacgccaucaacuucgagagcaacgggaacuucaucgcgcccgaguacgccuacaagaucgugaagaagggcgacagcacgaucaugaaguccgagcuggaguacggcaacugcaacaccaagugccagaccccgaugggggccaucaacagcuccaugcccuuccacaacauccacccccugaccaucggcgagugccccaaguacgucaagagcaaccgccucgugcuggccacggggcugcggaacuccccgcagcgcgagacccggggccucuucggcgccaucgcgggguucaucgagggcggguggcagggcaugguggacgggugguacggcuaccaccacagcaacgagcagggcuccggguacgccgccgacaaggagagcacccagaaggccaucgacggcgucaccaacaaggugaacuccaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacagcaacgucaagaaccuguacgacaaggugcgccuccagcugcgggacaacgccaaggagcuggggaacggcugcuucgaguucuaccacaagugcgacaacgagugcauggaguccgugcgcaacggcaccuacgacuacccccaguacagcgaggaggcccggcucaagcgcgaggagaucuccggggucaagcuggagagcaucggcaucuaccagauccuguccaucuacagcacgguggccuccagccucgcccuggcgaucaugguggccgggcugucccucuggaugugcagcaacggcagccugcagugccggaucugcaucuga

SEQ ID NO: 74875 - RNA, 1695 nt, Artificial Sequence
  derived and/or modified sequence opt1 from hemagglutinin__InfluenzaA__ABW90132
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccaccaucaagcggagcuacaacaacacgaaccaggaggaccuccuggugcugugggggauccaccaccccaacaacgcggccgagcagaccgagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgagagcaacgggaacuucaucgcgcccgaguacgccuacaagaucgugaagaagggcgacuccacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacagcccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagagcgugcgcaacggcaccuacgacuacccccaguacuccgaggaggcccggcucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcaucuga

SEQ ID NO: 74876 - RNA, 1695 nt, Artificial Sequence
  derived and/or modified sequence opt1 from hemagglutinin__InfluenzaA__ABW90133
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugccccuaccagggcaagcccuccuucuuccgcaacguggucuggcugaucaagaagaacagcaccuaccccaccaucaagcgguccuacaacaacacgaaccaggaggaccuccuggugcugugggggauccaccacccgaacgacgcggccgagcagaccaagcucuaccagaaccccaccaccuacaucagcgugggcacguccacccugaaccagcgccuggucccccggaucgccacccgcagcaaggugaacgggcaguccggccggauggaguucuucuggaccauccucaagcccaacgacgccaucaacuucgagagcaacgggaacuucaucgcgccggaguacgccuacaagaucgugaagaagggcgacagcacgaucaugaaguccgagcuggaguacggcaacugcaacaccaagugccagacccccaugggggccaucaacagcuccaugcccuuccacaacauccacccccugaccaucggcgagugcccgaaguacgucaagagcaaccgccucgugcuggccacggggcugcggaacuccccgcagcgcgagacccggggccucuucggcgccaucgcgggguucaucgagggcggguggcagggcaugguggacgggugguacggcuaccaccacagcaacgagcagggcuccggguacgccgccgacaaggagagcacccagaaggccaucgacggcgucaccaacaaggugaacuccaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacagcaacgucaagaaccuguacgacaaggugcgccuccagcugcgggacaacgccaaggagcuggggaacggcugcuucgaguucuaccacaagugcgacaacgagugcauggaguccgugcgcaacggcaccuacgacuacccccaguacagcgaggaggcccggcucaagcgcgaggagaucuccggggucaagcuggagagcaucggcaucuaccagauccuguccaucuacagcacgguggccuccagccucgcccuggcgaucaugguggccgggcugucccucuggaugugcagcaacggcagccugcagugccggaucugcaucuga

SEQ ID NO: 74877 - RNA, 1695 nt, Artificial Sequence
  derived and/or modified sequence opt1 from hemagglutinin__InfluenzaA__ABW90134
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccaggagaaguccagcuucuuccgcaacguggucuggcugaucaagaagaacuccaccuaccccaccaucaagcggagcuacaacaacacgaaccaggaggaccuccuggugcuguggggcauccaccaccccaacgacgcggccgagcagaccaagcucuaccagaacccgaccaccuacaucuccguggggacgagcacccugaaccagcgccuggucccccggaucgccacccgcuccaaggugaacggccagagcgggcggauggaguucuucuggaccauccucaagcccaacgacgccaucaacuucgagagcaacggcaacuucaucgcgcccgaguacgccuacaagaucgugaagaagggggacuccacgaucaugaaguccgagcuggaguacggcaacugcaacaccaagugccagaccccgaugggcgccaucaacagcagcaugcccuuccacaacauccacccccugaccaucggggagugccccaaguacgucaaguccaaccgccucgugcuggccacgggccugcggaacagcccgcagcgcgagacccggggccucuucggggccaucgcgggcuucaucgagggcggguggcaggggaugguggacggcugguacggguaccaccacuccaacgagcagggcagcggcuacgccgccgacaaggaguccacccagaaggccaucgacggggucaccaacaaggugaacagcaucaucgacaagaugaacacgcaguucgaggccgugggccgcgaguucaacaaccuggagcggcgcaucgagaaccugaacaagaagauggaggacggguuccucgacgucuggaccuacaacgcggagcugcuggugcucauggagaacgagcggacccuggacuuccacgacuccaacgucaagaaccuguacgacaaggugcgccuccagcugcgggacaacgccaaggagcugggcaacgggugcuucgaguucuaccacaagugcgacaacgagugcauggagagcgugcgcaacggcaccuacgacuacccccaguacuccgaggaggcccggcucaagcgcgaggagaucagcggcgucaagcuggaguccaucgggaucuaccagauccugagcaucuacuccacgguggccagcucccucgcccuggcgaucaugguggccggccugagccucuggaugugcagcaacgggucccugcagugccggaucugcaucuga

SEQ ID NO: 74878 - RNA, 1695 nt, Artificial Sequence
  derived and/or modified sequence opt1 from hemagglutinin__InfluenzaA__ABW90135
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaacaagaacuccaccuaccccaccaucaagcggagcuacaacaacacgaaccaggaggaccuccuggugcugugggggauccaccaccccaacgacgcggccgagcagaccaagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgagagcaacgggaacuucaucgcgcccgaguacgccuacaagaucgugaagaagggcgacuccacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacagcccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagagcgugcgcaacggcaccuacgacuacccccaguacuccgaggaggcccggcucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcaucuga

SEQ ID NO: 74879 - RNA, 1695 nt, Artificial Sequence
  derived and/or modified sequence opt1 from hemagglutinin__InfluenzaA__HB649491
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccaccaucaagcggagcuacaacaacacgaaccaggaggaccuccuggugcugugggggauccaccaccccaacgacgcggccgagcagaccaagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgagagcaacgggaacuucaucgcgcccgaguacgccuacaagaucgugaagaagggcgacuccacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacagcccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagagcgugcgcaacggcaccuacgacuacccccaguacuccgaggaggcccggcucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcaucuga

SEQ ID NO: 74880 - RNA, 1683 nt, Artificial Sequence; identical to SEQ ID NO: 70996
  derived and/or modified sequence opt1 from hemagglutinin__InfluenzaA__EPI439507

SEQ ID NO: 74881 - RNA, 1701 nt, Artificial Sequence
  derived and/or modified sequence opt1 from hemagglutinin__InfluenzaA__EPI482777
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagagccucuccaccgccagcuccuggagcuacaucguggagacguccaacagcgacaacgggaccugcuaccccggcgacuucaucaacuacgaggagcugcgcgagcagcuguccagcguguccagcuucgagcgguucgagaucuuccccaagaccuccagcuggcccaaccacgacaccaaccgcggcgucacggccgccugcccgcacgccggcgccaacuccuucuaccggaaccucguguggcuggugaagaaggggaacagcuaccccaagaucaacaaguccuacaucaacaacaaggagaaggagguccuggugcucugggcgauccaccaccccagcaccuccgccgaccagcagagccuguaccagaacgccgacgccuacguguucgucggcagcucccgcuacagccggaaguucgagcccgagaucgccacccgcccgaaggugcgggaccaggcggggcgcaugaacuacuacuggacccugguggagcccggcgacaagaucacguucgaggccaccggcaaccucgucgcgccccgguacgccuucgcccugaagcgcaacuccgggagcggcaucaucaucuccgacaccagcgugcacgacugcgacaccacgugccagacccccaacggggccaucaacaccucccugccguuccagaacauccaccccgugaccaucggcgagugccccaaguacgucaagagcacgaagcuccggauggccaccggccugcgcaacauccccuccauccagagccgggggcuguucggcgccaucgccggguucaucgagggcggguggaccggcaugaucgacggcugguacggguaccaccaccagaacgagcagggcuccggguacgccgcggaccucaagagcacccagaacgccaucgacggcaucacgaacaaggugaacuccgugaucgagaagaugaacacccaguucaccgccgucgggaaggaguucagccaccuggagcgccggaucgagaaccugaacaagaagguggacgacggcuuccucgacaucuggaccuacaacgccgagcugcugguccuccuggagaacgagcgcacgcuggacuaccacgacuccaacgugaagaaccucuacgagaaggugcggagccagcugaagaacaacgccaaggagaucggcaacgggugcuucgaguucuaccacaagugcgacgacaugugcauggaguccgucaagaacggcaccuacgacuacccgaaguacagcgaggaggcgaagcugaaccgcgaggagaucgacggggugaagcucgaguccacccggaucuaccagauccuggccaucuacagcaccguggccagcucccugguccucguggugagccugggcgccaucuccuucuggaugugcagcaacgggucccugcagugccgcaucugcaucuga

SEQ ID NO: 74882 - RNA, 1701 nt, Artificial Sequence; identical to SEQ ID NO: 66592
  derived and/or modified sequence opt1 from hemagglutinin__InfluenzaA__EPI745532

SEQ ID NO: 74883 - RNA, 1701 nt, Artificial Sequence
  derived and/or modified sequence opt1 from hemagglutinin__InfluenzaA__EPI278594
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgagagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 74884 - RNA, 1701 nt, Artificial Sequence
  derived and/or modified sequence opt1 from hemagglutinin__InfluenzaA__AEE69009
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccacccgcccaccagcgccgaccagcagagccuguaccagaacgccgacacguacguguucgugggcuccagccgguacuccaagaaguucaagcccgagaucgccauccgccccaagguccgggaccaggagggccgcaugaacuacuacuggacccugguggagcccggggacaagaucaccuucgaggccaccggcaaccucguggucccgcgguacgcguucgccauggagcgcaacgccgggagcggcaucaucaucuccgacacgcccgugcacgacugcaacacgaccugccagacccccaagggcgccaucaacaccagccugcccuuccagaacauccacccgaucaccaucgggaagugccccaaguacgugaaguccaccaagcugcggcucgccaccggccugcgcaacauccccagcauccagucccgggggcuguucggcgcgaucgccggguucaucgagggcggcuggacggggauggucgacggcugguacggguaccaccaccagaacgagcagggcagcggguacgccgccgaccucaaguccacccagaacgccaucgacgagaucaccaacaaggugaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacagcaccguggcguccagccugguccucguggugagccugggggccaucuccuucuggaugugcagcaacggcucccugcagugccggaucugcaucuga

SEQ ID NO: 74885 - RNA, 1701 nt, Artificial Sequence; identical to SEQ ID NO: 63959
  derived and/or modified sequence opt1 from hemagglutinin__InfluenzaA__GQ280797

SEQ ID NO: 74886 - RNA, 1701 nt, Artificial Sequence; identical to SEQ ID NO: 63692
  derived and/or modified sequence opt1 from hemagglutinin__InfluenzaA__EPI178457

SEQ ID NO: 74887 - RNA, 1701 nt, Artificial Sequence; identical to SEQ ID NO: 63692
  derived and/or modified sequence opt1 from hemagglutinin__InfluenzaA__EPI176470

SEQ ID NO: 74888 - RNA, 1701 nt, Artificial Sequence
  derived and/or modified sequence opt1 from hemagglutinin__InfluenzaA__EPI280341
augaaggccauccuggugguccuccugcacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccacccuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgaagguccggaaccaggagggccgcaugaacuacuacuggacccugguggagcccggggacaagaucaccuucgaggcgacgggcaaccucguggcgccccgguacgccuucgccauggagcgcaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacccagaacgccaucgacaagaucaccaacaaggugaacuccgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 74889 - RNA, 1701 nt, Artificial Sequence
  derived and/or modified sequence opt1 from hemagglutinin__InfluenzaA__EPI240319
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggcgaccggcaaccugguggucccccgcuacgccuucgccauggagcggaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcgccuggcgaccggccuccggaacgucccgagcauccagucccgcgggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcggaucgagaaccugaacaagaaggucgacgacggcuuccuggacaucuggacguacaacgccgagcuccuggugcugcucgagaacgagcgcacccuggacuaccacgacuccaacgugaagaaccuguacgagaagguccggagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcuggaguccacccggaucuaccagauccucgcgaucuacagcaccgucgccagcucccuggugcugguggucagccucggggccaucuccuucuggaugugcagcaacggcucccugcagugccgcaucugcaucuga

SEQ ID NO: 74890 - RNA, 1701 nt, Artificial Sequence; identical to SEQ ID NO: 63857
  derived and/or modified sequence opt1 from hemagglutinin__InfluenzaA__EPI183134

SEQ ID NO: 74891 - RNA, 1701 nt, Artificial Sequence
  derived and/or modified sequence opt1 from hemagglutinin__InfluenzaA__EPI368693
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccuccugcccgcacgccggcgccaagagcuucuacaagaaccugaucuggcuggugaagaaggggaacuccuaccccaagcucagcaagagcuacaucaacgacaagggcaaggaggugcugguccugugggggauccaccaccccuccaccagcgcggaccagcagucccucuaccagaacgccgacgccuacguguucgugggcagcucccgguacagcaagaaguucaagcccgagaucgccauccgcccgaagguccggggccaggaggggcgcaugaacuacuacuggacgcugguggagcccggcgacaagaucaccuucgaggccaccgggaaccugguggucccccgguacgcguucgccauggagcgcaacgccggcuccggcaucaucaucagcgacacccccgugcacgacugcaacacgaccugccagaccccgaagggggccaucaacaccucccuccccuuccagaacauccaccccaucacgaucggcaagugccccaaguacgucaagagcaccaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacgcagaacgccaucgacgagaucaccaacaaggugaacuccgucaucgagaagaugaacacccaguucaccgcggugggcaaggaguucaaccaccuggagaagcgcaucgagaaccugaacaagaaggucgacgacggguuccuggacaucuggacguacaacgccgagcuccuggugcugcucgagaacgagcggacccuggacuaccacgacagcaacgugaagaaccuguacgagaagguccgcucccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagagcacccgcaucuaccagauccucgccaucuacagcaccgucgcguccagccuggugcugguggucucccucggcgccaucagcuucuggaugugcuccaacggcagccugcagugccggaucugcaucuga

SEQ ID NO: 74892 - RNA, 1701 nt, Artificial Sequence
  derived and/or modified sequence opt1 from hemagglutinin__InfluenzaA__EPI291788
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagagccucuccaccgccagcuccuggagcuacaucguggagacguccaacagcgacaacgggaccugcuaccccggcgacuucaucaacuacgaggagcugcgcgagcagcuguccagcguguccagcuucgagcgguucgagaucuuccccaagaccuccagcuggcccaaccacgacaccaaccgcggcgucacggccgccugcccgcacgccggcaccaacuccuucuaccggaaccucaucuggcuggugaagaaggggaacagcuaccccaagaucaacaaguccuacaucaacaacaaggagaaggaggugcugguccucugggccauccaccaccccagcaccuccgcggaccagcagagccuguaccagaacgccgacgccuacguguucgugggcagcucccgcuacagccggaaguucgagcccgagaucgccacccgcccgaagguccgggaccaggccgggcgcaugaacuacuacuggacgcugguggagcccggcgacaagaucaccuucgaggcgaccggcaaccucguggucccccgguacgccuucgcccugaagcgcaacuccgggagcggcaucaucaucuccgacaccagcgugcacgacugcgacacgaccugccagacccccaacggggccaucaacaccucccugccguuccagaacauccaccccgugacgaucggcgagugccccaaguacgucaagagcaccaagcuccggauggccaccggccugcgcaacauccccuccauccagagccgggggcuguucggcgcgaucgccggguucaucgagggcggguggaccggcaugaucgacggcugguacggguaccaccaccagaacgagcagggcuccggguacgccgccgaccucaagagcacgcagaacgccaucgacggcaucaccaacaaggugaacuccgugaucgagaagaugaacacccaguucaccgcggucgggaaggaguucagccaccuggagcgccggaucgagaaccugaacaagaagguggacgacggcuuccucgacaucuggacguacaacgccgagcugcugguccuccuggagaacgagcgcacccuggacuaccacgacuccaacgugaagaaccucuacgagaaggugcggagccagcugaagaacaacgccaaggagaucggcaacgggugcuucgaguucuaccacaagugcgacgacacgugcauggaguccgucaagaacggcaccuacgacuacccgaaguacagcgaggaggccaagcugaaccgcgaggagaucgacggggugaagcucgaguccacccggaucuaccagauccuggccaucuacagcaccguggcgagcucccugguccucguggugagccugggcgccaucuccuucuggaugugcagcaacgggucccugcagugccgcaucugcaucuga

SEQ ID NO: 74893 - RNA, 1701 nt, Artificial Sequence
  derived and/or modified sequence opt1 from hemagglutinin__InfluenzaA__EPI482788
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagagccucuccaccgccagcuccuggagcuacaucguggagacguccaacagcgacaacgggaccugcuaccccggcgacuucaucaacuacgaggagcugcgcgagcagcuguccagcguguccagcuucgagcgguucgagaucuuccccaagaccuccagcuggcccaaccacgacaccaaccgcggcgucacggccgccugcccgcacgccggcaccaacuccuucuaccggaaccucaucuggcuggugaagaaggggaacagcuaccccaagaucaacaaguccuacaucaacaacaaggagaaggaggugcugguccucugggccauccaccaccccagcaccuccgcggaccagcagagcaucuaccagaacgccgacgccuacguguucgugggcagcucccgcuacagccggaaguucgagcccgagaucgccacccgcccgaagguccgggaccaggccgggcgcaugaacuacuacuggacgcugguggagcccggcgacaagaucaccuucgaggcgaccggcaaccugguggucccccgguacgccuucgcccucaagcgcaacuccgggagcggcaucaucaucuccgacaccagcgugcacgacugcgacacgaccugccagacccccaacggggccaucaacaccucccugccguuccagaacauccaccccgugacgaucggcgagugccccaaguacgucaagagcaccaagcugcggauggccaccggccuccgcaacauccccuccauccagagccgggggcuguucggcgcgaucgccggguucaucgagggcggguggaccggcaugaucgacggcugguacggguaccaccaccagaacgagcagggcuccggguacgccgccgaccucaagagcacgcagaacgccaucgacggcaucaccaacaaggugaacuccgugaucgagaagaugaacacccaguucaccgcggucgggaaggaguucagccaccuggagcgccggaucgagaaccugaacaagaagguggacgacggcuuccuggacaucuggacguacaacgccgagcuccugguccugcucgagaacgagcgcacccuggacuaccacgacuccaacgugaagaaccuguacgagaaggugcggagccagcucaagaacaacgccaaggagaucggcaacgggugcuucgaguucuaccacaagugcgacgacacgugcauggaguccgucaagaacggcaccuacgacuacccgaaguacagcgaggaggccaagcugaaccgcgaggagaucgacggggugaagcuggaguccacccggaucuaccagauccucgccaucuacagcaccguggcgagcucccugguccugguggugagccucggcgccaucuccuucuggaugugcagcaacgggucccugcagugccgcaucugcaucuga

SEQ ID NO: 74894 - RNA, 1701 nt, Artificial Sequence
  derived and/or modified sequence opt1 from hemagglutinin__InfluenzaA__EPI178946/m1
augaaggccaucaucgugguccugcucuacaccuucgccaccgcggacgccgacacgcugugcaucggcuaccacgccaacaacagcaccgacaccguggacaccgugcuggagaagaacgucacggugacccacuccgugaaccuccuggagaacaagcacgacgggaagcugugcaagcuccgcggcgucgcgccccugcaccuggggaagugcaacaucgccggcuggcuccuggggaacccggagugcgagagccuguucaccgccuccagcugguccuacaucguggagacccccaacagcgacaacggcacgugcuaccccggcgacuucaucaacuacgaggagcuccgggagcaccuguccagcguguccagcuucgagcgcuucgagaucuuccccaaggccaacuccuggccgaaccacgacaccaacaagggggucaccgccgccugccccuacgcgggcgccaacagcuucuaccggaaccugaucuggcucgugaagaaggggaacuccuaccccaagcugagcaaguccuacaucaacaacaagaagaaggaggugcuggucaucuggggcauccaccacccgcccaccagcacggaccagcagacccucuaccagaacgccgacgccuacguguucgugggguccagcaaguacuccaagcgcuucaagcccgagaucgccgcgcggcccaagguccgcaaccaggccggccggaugaacuacuacuggacccugaucgagcccggcgacaccaucacguucgaggccaccgggaaccugguggugccgcgcuacgccuucgccaugaagcggggcagcgggagcggcaucaucgucuccgacgcgcccgugcacgacugcaacacgaccugccagacccccaagggcgccaucaacaccagccuccccuuccagaacauccacccggugaccaucggggagugccccaaguacgucaaguccaccaagcugcgcauggccacgggccugcggaacauccccagcauccagucccgcggccucuucggggccaucgccggguuccuggagggcggcuggaccgggaugaucgacggcugguacggguaccaccaccagaacgagcagggcagcggguacgcggccgaccagaaguccacccagaacgccaucgacggcaucaccaacaaggugaacagcaucaucgagaagaugaacacgcaguucaccgccgugggcaaggaguucaaccagcuggagaagcggaucgagucccucaacaacaaggucgacgacggguuccuggacaucuggaccuacaacgccgagaugcuggugcuccuggagaacgagcgcacccuggacuaccacgacagcaacgucaagaaccucuacgagaaggugcggucccagcugaagaacaacgcgaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggucaagcucgagagcgcccggaucuaccagauccuggccaucuacuccaccguggcgagcucccuggugcuccuggucagccugggcgccguguccuucuggaugugcagcaacggcagccuccagugccgcaucugcaucuga

SEQ ID NO: 74895 - RNA, 1701 nt, Artificial Sequence
  derived and/or modified sequence opt1 from hemagglutinin__InfluenzaA__EPI482791/m2
augaaggccaucaucgugguccugcucuacaccuucgccaccgcggacgccgacacgcugugcaucggcuaccacgccaacaacagcaccgacaccguggacaccgugcuggagaagaacgucacggugacccacuccgugaaccuccuggagaacaagcacgacgggaagcugugcaagcuccgcggcgucgcgccccugcaccuggggaagugcaacaucgccggcuggcuccuggggaacccggagugcgagagccuguucaccgccuccagcugguccuacaucguggagacccccaacagcgacaacggcacgugcuaccccggcgacuucaucaacuacgaggagcuccgggagcaccuguccagcguguccagcuucgagcgcuucgagaucuuccccaaggccaacuccuggccgaaccacgagaccaacaagggggucaccgccgccugccccuacgcgggcgccaacagcuucuaccggaaccugaucuggcucgugaagaaggggaacuccuaccccaagcugagcaaguccuacaucaacaacaagaagaaggaggugcuggucaucuggggcauccaccacccgcccaccagcacggaccagcagacccucuaccagaacgccgacgccuacguguucgugggguccagcaaguacuccaagcgcuucaagcccgagaucgccgcgcggcccaagguccgcaaccaggccggccggaugaacuacuacuggacccugaucgagcccggcgacaccaucacguucgaggccaccgggaaccugguggugccgcgcuacgccuucgccaugaagcggggcagcgggagcggcaucaucgucuccgacgcgcccgugcacgacugcaacacgaccugccagacccccaagggcgccaucaacaccagccuccccuuccagaacauccacccggugaccaucggggagugccccaaguacgucaaguccaccaagcugcgcauggccacgggccugcggaacauccccagcauccagucccgcggccucuucggggccaucgccggguuccuggagggcggcuggaccgggaugaucgacggcugguacggguaccaccaccagaacgagcagggcagcggguacgcggccgaccagaaguccacccagaacgccaucgacggcaucaccaacaaggugaacagcaucaucgagaagaugaacacgcaguucaccgccgugggcaaggaguucaaccagcuggagaagcggaucgagucccucaacaacaaggucgacgacggguuccuggacaucuggaccuacaacgccgagaugcuggugcuccuggagaacgagcgcacccuggacuaccacgacagcaacgucaagaaccucuacgagaaggugcggucccagcugaagaacaacgcgaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggucaagcucgagagcgcccggaucuaccagauccuggccaucuacuccaccguggcgagcucccuggugcuccuggucagccugggcgccguguccuucuggaugugcagcaacggcagccuccagugccgcaucugcaucuga

SEQ ID NO: 74896 - RNA, 1701 nt, Artificial Sequence
  derived and/or modified sequence opt1 from hemagglutinin__InfluenzaA__EPI291799
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagagccucuccaccgccagcuccuggagcuacaucguggagacguccaacagcgacaacgggaccugcuaccccggcgacuucaucaacuacgaggagcugcgcgagcagcuguccagcguguccagcuucgagcgguucgagaucuuccccaagaccuccagcuggcccaaccacgacaccaaccgcggcgucacggccgccugcccgcacgccggcaccaacuccuucuaccggaaccucaucuggcuggugaagaaggggaacagcuaccccaagaucaacaaguccuacaucaacaacaaggagaaggaggugcugguccucugggccauccaccaccccagcaccuccgcggaccagcagagccuguaccagaacgccgacgccuacguguucgugggcagcucccgcuacagccggaaguucgagcccgagaucgccacccgcccgaagguccgggaccaggccgggcgcaugaacuacuacuggacgcugguggagcccggcgacaagaucaccuucgaggcgaccggcaaccucguggucccccgguacgccuucgcccugaagcgcaccuccgggagcggcaucaucaucuccgacacgagcgugcacgacugcgacacgaccugccagacccccaacggggccaucaacaccucccugccguuccagaacauccaccccgugaccaucggcgagugccccaaguacgucaagagcaccaagcuccggauggccaccggccugcgcaacauccccuccauccagagccgggggcuguucggcgcgaucgccggguucaucgagggcggguggacgggcaugaucgacggcugguacggguaccaccaccagaacgagcagggcuccggguacgccgccgaccucaagagcacccagaacgccaucgacggcaucaccaacaaggugaacuccgugaucgagaagaugaacacccaguucacggcggucgggaaggaguucagccaccuggagcgccggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggagccagcugaagaacaacgccaaggagaucggcaacgggugcuucgaguucuaccacaagugcgacgacacgugcauggaguccgucaagaacggcaccuacgacuacccgaaguacagcgaggaggccaagcugaaccgcgaggagaucgacggggugaagcucgaguccacccggaucuaccagauccuggccaucuacagcaccguggcgagcucccugguccucguggugagccugggcgccaucuccuucuggaugugcagcaacgggucccugcagugccgcaucugcaucuga

SEQ ID NO: 74897 - RNA, 1701 nt, Artificial Sequence
  derived and/or modified sequence opt1 from hemagglutinin__InfluenzaA__EPI482799
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagagccucuccaccgccagcuccuggagcuacaucguggagacguccaacagcgacaacgggaccugcuaccccggcgacuucaucaacuacgaggagcugcgcgagcagcuguccagcguguccagcuucgagcgguucgagaucuuccccaagaccuccagcuggcccaaccacgagaccaaccgcggcgucacggccgccugcccgcacgccggcaccaacuccuucuaccggaaccucaucuggcuggugaagaaggggaacagcuaccccaagaucaacaaguccuacaucaacaacaaggagaaggaggugcugguccucugggccauccaccaccccagcaccuccgcggaccagcagagccuguaccagaacgccgacgccuacguguucgugggcagcucccgcuacagccggaaguucgagcccgagaucgccacccgcccgaagguccgggaccaggccgggcgcaugaacuacuacuggacgcugguggagcccggcgacaagaucaccuucgaggcgaccggcaaccucguggucccccgguacgccuucgcccugaagcgcaccuccgggagcggcaucaucaucuccgacacgagcgugcacgacugcgacacgaccugccagacccccaacggggccaucaacaccucccugccguuccagaacauccaccccgugaccaucggcgagugccccaaguacgucaagagcaccaagcuccggauggccaccggccugcgcaacauccccuccauccagagccgggggcuguucggcgcgaucgccggguucaucgagggcggguggacgggcaugaucgacggcugguacggguaccaccaccagaacgagcagggcuccggguacgccgccgaccucaagagcacccagaacgccaucgacggcaucaccaacaaggugaacuccgugaucgagaagaugaacacccaguucacggcggucgggaaggaguucagccaccuggagcgccggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggagccagcugaagaacaacgccaaggagaucggcaacgggugcuucgaguucuaccacaagugcgacgacacgugcauggaguccgucaagaacggcaccuacgacuacccgaaguacagcgaggaggccaagcugaaccgcgaggagaucgacggggugaagcucgaguccacccggaucuaccagauccuggccaucuacagcaccguggcgagcucccugguccucguggugagccugggcgccaucuccuucuggaugugcagcaacgggucccugcagugccgcaucugcaucuga

SEQ ID NO: 74898 - RNA, 1701 nt, Artificial Sequence
  derived and/or modified sequence opt1 from hemagglutinin__InfluenzaA__EPI291807
augaaggccaucaucgugguccugcucuacaccuucgccaccgcggacgccgacacgcugugcaucggcuaccacgccaacaacagcaccgacaccguggacaccgugcuggagaagaacgucacggugacccacuccgugaaccuccuggagaacaagcacgacgggaagcugugcaagcuccgcggcgucgcgccccugcaccuggggaagugcaacaucgccggcuggcuccuggggaacccggagugcgagagccuguucgccgccuccagcugguccuacaucguggagacccccaacagcgacaacgggaccugcuaccccggcgacuucaucaacuacgaggagcuccgggagcaccuguccagcguguccagcuucgagcgcuucgagaucuuccccaaggccaacuccuggccgaaccacgacacgaacaagggggucaccgccgcgugccccuacgccggcgccaacagcuucuaccggaaccugaucuggcucgugaagaaggggaacuccuaccccaagcugagcaaguccuacaucaacaacaagaagaaggaggugcuggucaucuggggcauccaccacccgcccaccagcaccgaccagcagacgcucuaccagaacgccgacgccuacguguucgugggguccagcaaguacuccaagcgcuucaagcccgagaucgcggcccggcccaagguccgcgaccaggccggccggauggacuacuacuggacccugaucgagcccggcgacaccaucaccuucgaggccacggggaaccugguggugccgcgcuacgccuucgcgaugaagcggggcagcgggagcggcaucaucgucuccgacgcccccgugcacgacugcaacacgaccugccagacccccaagggcgccaucaacaccagccuccccuuccagaacauccacccggugaccaucggggagugccccaaguacgucaaguccaccaagcugcgcauggccaccggccugcggaacauccccagcauccagucccgcggccucuucggcgccaucgcgggguucaucgagggcggcuggacggggaugaucgacggcugguacggguaccaccaccagaacgagcagggcagcggguacgccgccgaccagaaguccacccagaacgccaucgacggcaucaccaacaaggugaacagcaucaucgagaagaugaacacccaguucacggccgugggcaaggaguucucccagcuggagaagcggaucgagagccugaacaacaaggucgacgacggguuccucgacaucuggaccuacaacgcggagcugcuggugcuccuggagaacgagcgcacccuggacuaccacgacuccaacgucaagaaccucuacgagaaggugcggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggucaagcucgaguccgcccggaucuaccagauccuggcgaucuacagcaccguggccuccagccuggugcuccuggucucccugggcgccgugagcuucuggaugugcagcaacggcucccuccagugccgcaucugcaucuga

SEQ ID NO: 74899 - RNA, 1701 nt, Artificial Sequence
  derived and/or modified sequence opt1 from hemagglutinin__InfluenzaA__EPI638970
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggauccuggggaacccggagugcgagagccuguccaccgccagcuccuggagcuacaucguggagacguccaacagcgagaacgggaccugcuaccccggcgacuucaucaacuacgaggagcuccgcgagcagcuguccagcguguccagcuucgagcgguucgagaucuuccccaagaccuccagcuggcccaaccacgacaccaacaagggcgucacggccgccugcccgcacuccggcaccaacagcuucuaccgcaaccugguguggcucgugcagaaggggaacuccuaccccaagaucaacaagagcuacaucaacaacaaggagaacgagguccuggugcugugggccauccaccaccccuccaccagcgccgaccagcagagccucuacaagaacgcggacgccuacguguucgucggcuccagccgguacucccgcaaguucgagcccgagaucgccacccggccgaaggugcgcgaccaggccgggcggaugaacuacuacuggacgcugguggagcccggcgacaagaucaccuucgaggccaccggcaaccuggucgcgccccgcuacgccuucacccucaagcggaacagcggguccggcaucaucaucagcgacacguccgugcacgacugcgacacgaccugccagacccccaacggggccaucaacaccagccugccguuccagaacauccaccccgugaccaucggcgagugccccaaguacgucaaguccaccaagcugcgcauggccaccggccuccggaacauccccagcauccagucccgcgggcuguucggcgccaucgcgggguucaucgagggcggguggacgggcaugaucgacggcugguacggguaccaccaccagaacgagcagggcagcggguacgccgccgaccugaaguccacccagaacgccaucgacggcaucaccaacaaggugaacagcgugaucgagaagaugaacacccaguucacggccgucgggaaggaguucucccaccucgagcggcgcaucgagaaccugaacaagaagguggacgacggcuuccuggacaucuggaccuacaacgcggagcuccugguccugcucgagaacgagcggacccuggacuaccacgacagcaacgugaagaaccuguacgagaaggugcgcucccagcucaagaacaacgccaaggagaucggcaacgggugcuucgaguucuaccacaagugcgacgacaugugcauggagagcgucaagaacggcaccuacgacuacccgaaguacuccgaggaggccaagcugaaccgggaggagaucgacggggugaagcuggagagcacgaagaucuaccagauccucgccaucuacagcaccguggccuccagccugguccugguggugucccucggcgcgaucagcuucuggaugugcuccaacgggagccugcagugccgcaucugcaucuga

SEQ ID NO: 74900 - RNA, 1701 nt, Artificial Sequence
  derived and/or modified sequence opt1 from hemagglutinin__InfluenzaA__ABI19015
augaaggccaucaucgugguccugcucuacaccuucgccaccgcggacgccgacacgcugugcaucggcuaccacgccaacaacagcaccgacaccguggacaccgugcuggagaagaacgucacggugacccacuccgugaaccuccuggagaacaagcacgacgggaagcugugcaagcuccgcggcaucgcgccccugcaccuggggaagugcaacaucgccggcuggauccucgggaacccggagugcgagagccuguucaccaccuccagcugguccuacaucgucgagacgcccaacagcgacaacgggaccugcuaccccggcgacuucaucaacuacgaggagcugcgggagcaccucuccagcguguccagcuucgagcgcuucgagaucuuccccaaggccaacuccuggccguaccacgacaccaacaagggcgugaccgccgccugccccuacgccggcgcgaacagcuucuaccggaaccugaucuggcuggucaagaaggggaacuccuaccccaagcucagcaaguccuacaucaacaacaagaagaaggaggugcuggugaucuggggcauccaccacccgcccacgagcaccgaccagcagacccuguaccagaacgccgacgccuacgucuucgugggguccagcaaguacuccaagcgcuucaagcccgagaucgccgcccggcccaaggugcgcgaccaggcgggccggauggacuacuacuggacccucaucgagcccggcgacacgaucaccuucgaggccaccgggaaccuggucgugccgcgcuacgccuucaccaugaagcggggcagcgggagcggcaucaucguguccgacgcccccguccacgacugcaacacgaccugccagacccccaagggcgccaucaacaccagccugcccuuccagaacauccacccggugacgaucggggagugccccaaguacgugaaguccaccaagcuccgcauggcgaccggccugcggaacauccccagcauccagucccgcgggcuguucggcgccaucgccggguucaucgagggcggcuggaccgggaugaucgacggcugguacggguaccaccaccagaacgagcagggcagcggguacgccgccgaccagaaguccacgcagaacgcgaucgacggcaucaccaacaaggucaacagcaucaucgagaagaugaacacccaguucaccgccgugggcaaggaguucucccagcucgagaagcggaucgagagccugaacaacaagguggacgacggguuccuggacaucuggacguacaacgccgagcuccugguccugcucgagaacgagcgcacccuggacuaccacgacuccaacgugaagaaccuguacgagaagguccggagccagcucaagaacaacgccaaggagaucggcaacgggugcuucgaguucuaccacaagugcgacgacacgugcauggaguccgugaagaacggcaccuacgacuaccccaaguacagcgaggaggccaagcugaaccgccaggagaucgacggggugaagcuggaguccgcgcggaucuaccagauccucgccaucuacagcaccgucgccuccagccuggugcugcucgugucccugggcgccgucagcuucuggaugugcagcaacggcucccugcagugccgcaucugcaucuga

SEQ ID NO: 74901 - RNA, 1701 nt, Artificial Sequence
  derived and/or modified sequence opt1 from hemagglutinin__InfluenzaA__EPI687790
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugggcggggucgcgccccugcaccucggcaagugcaacaucgccggguggauccugggcaacccggagugcgagagccuguccaccgccagcuccuggagcuacaucguggagacguccaacagcgacaacgggaccugcuaccccggcgacuucaucaacuacgaggagcuccgcgagcagcuguccagcguguccagcuucgagcgguucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugaaccagagcuacaucaacgacaaggggaaggaggugcugguccucuggggcauccaccaccccuccacgaccgcggaccagcagagccuguaccagaacgccgacgccuacguguucgugggcaccagccgcuacuccaagaaguucaagcccgagaucgccacccggccgaagguccgcgaccaggaggggcggaugaacuacuacuggacgcugguggagcccggcgacaagaucaccuucgaggccaccgggaaccucguggucccccgcuacgcguucaccauggagcggaacgccggcagcggcaucaucaucuccgacacgcccgugcacgacugcaacacgaccugccagaccccggagggggccaucaacaccagccugcccuuccagaacauccaccccaucaccaucggcaagugccccaaguacgugaaguccaccaagcugcgccucgccaccgggcugcggaacgucccgagcauccagucccgcggccuguucggggccaucgcgggcuucaucgagggcggguggacgggcaugguggacgggugguacggcuaccaccaccagaacgagcaggggagcggcuacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggguuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgagaagaucgacggggugaagcucgagagcacccggaucuaccagauccuggccaucuacuccaccgucgccagcucccuggugcucguggucagccugggcgcgaucuccuucuggaugugcagcaacggcagccugcagugccgcaucugcaucuga

SEQ ID NO: 74902 - RNA, 1701 nt, Artificial Sequence
  derived and/or modified sequence opt1 from hemagglutinin__InfluenzaA__EPI841265
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugggcggggucgcgccccugcaccucggcaagugcaacaucgccggguggauccugggcaacccggagugcgagagccuguccaccgccagcuccuggagcuacaucguggagacguccaacagcgacaacgggaccugcuaccccggcgacuucaucaacuacgaggagcuccgcgagcagcuguccagcguguccagcuucgagcgguucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugaaccagagcuacaucaacgacaaggggaaggaggugcugguccucuggggcauccaccaccccuccacgaccgcggaccagcagagcaucuaccagaacgccgacgccuacguguucgugggcaccagccgcuacuccaagaaguucaagcccgagaucgccacccggccgaagguccgcgaccaggaggggcggaucaacuacuacuggacgcugguggagcccggcgacaagaucaccuucgaggccaccgggaaccugguggucccccgcuacgcguucaccauggagcggaacgccggcagcggcaucaucaucuccaacacgcccgugcacgacugcaacacgaccugccagaccccggagggggccaucaacaccagccuccccuuccagaacauccaccccaucaccaucggcaagugccccaaguacgugaaguccaccaagcugcgccuggccaccgggcuccggaacgucccgagcauccagucccgcggccuguucggggccaucgcgggcuucaucgagggcggguggacgggcaugguggacgggugguacggcuaccaccaccagaacgagcaggggagcggcuacgccgccgaccugaaguccacccagaacgccaucgacaagaucaccaacaaggugaacagcgucaucgagaagaugaacacccaguucacggccgugggcaaggaguucaaccaccucgagaagcggaucgagaaccugaacaagaaggucgacgacggguuccuggacaucuggaccuacaacgcggagcuccuggugcugcucgagaacgagcgcacccuggacuaccacgacuccaacgugaagaaccuguacgagaagguccggaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgcgagaagaucgacggggugaagcuggagagcacccggaucuaccagauccucgccaucuacuccaccgucgccagcucccuggugcugguggucagccucggcgcgaucuccuucuggaugugcagcaacggcagccugcagugccgcaucugcaucuga

SEQ ID NO: 74903 - RNA, 1701 nt, Artificial Sequence
  derived and/or modified sequence opt1 from hemagglutinin__InfluenzaA__EPI291846
augaaggccaucaucgugguccugcucuacaccuucgccaccgcggacgccgacacgcugugcaucggcuaccacgccaacaacagcaccgacaccguggacaccgugcuggagaagaacgucacggugacccacuccgugaaccuccuggagaacaagcacgacgggaagcugugcaaccucaagggcgucgcgccccugcaccuggggaagugcaacaucgccggcuggcuccuggggaacccggagugcgagagccuguucaccgccuccagcugguccuacaucguggagacccccaacagcgacaacggcacgugcuaccccggcgacuucaucaacuacgaggagcuccgcgagcaccuguccagcguguccagcuucgagcgguucgagaucuuccccaaggucaacuccuggccgaaccacgacaccaacaagggggugaccgccgccugccccuacgccggcgcgaacagcuucuaccgcaaccugaucuggcucgugaagaaggggaacuccuaccccaagcugagcaaguccuacaucaacaacaagaagaaggagguccuggugaucuggggcauccaccacccgcccaccagcacggaccagcagacccucuaccagaacgccgacgccuacguguucgucggguccagcaaguacuccaagcgguucgagcccgagaucgccgcccgccccaaggugcggaaccaggcgggccgcaugaacuacuacuggacccugaucgagcccggcgacaccaucacguucgaggccaccgggaaccugguggucccgcgguacgccuucgccaugcgccggggcagcgggagcggcaucaucguguccgacgcccccgugcacgacugcaacacgaccugccagacccccaagggcgcgaucaacaccagccuccccuuccagaacauccacccggucaccaucggggagugccccaaguacgugaaguccaccaagcugcgcauggccacgggccugcggaacauccccagcauccagucccgcggccucuucggggccaucgccggguuccuggagggcggcuggaccgggaugaucgacggcugguacggguaccaccaccagaacgagcagggcagcggguacgccgcggaccagaaguccacccagaacgccaucgacggcaucaccaacaaggugaacagcaucaucgagaagaugaacacgcaguucaccgccgucggcaaggaguucucccagcuggagaagcggaucgagagccucaacaacaagguggacgacggguuccuggacaucuggaccuacaacgccgagaugcugguccuccuggagaacgagcgcacccuggacuaccacgacuccaacgugaagaaccucuacgagaaggugcggagccagcugaagaacaacgccaaggagaucggcaacgggugcuucgaguucuaccacaagugcgacaacacgugcauggaguccguccgcaacggcaccuacgacuaccccaaguacagcgaggaggcgaagcugaaccgggaggagaucgacggggugaagcucgaguccgcccgcaucuaccagauccuggccaucuacagcaccguggccuccagccugguccuccuggugucccugggcgcggugagcuucuggaugugcagcaacggcucccuccagugccggaucugcaucuga

SEQ ID NO: 74904 - RNA, 1695 nt, Artificial Sequence
  derived and/or modified sequence opt1 from hemagglutinin__InfluenzaA__EPI558121
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagagccucuccaccgccagcuccuggagcuacaucguggagacguccaacagcgacaacgggaccugcuaccccggcgacuucaucaacuacgaggagcugcgcgagcagcuguccagcguguccagcuucgagcgguucgagaucuucccccagaccuccagcuggcccaaccacgacaccaaccgcggcgucacggccgccugcccgcacgccggcaccaacuccuucuaccggaaccucguguggcuggugaagaaggggaacagcuacuccaagaucaacaagagcuacaucaacaacaaggagaaggagguccuggugcucugggccauccaccaccccuccaccagcgcggaccagcagagccuguaccagaacgccgacgccuacguguucgucggcuccagccgcuacucccggaaguucgagcccgagaucgccacccgccccaaggugcgggaccaggccgggcgcaugaacuacuacuggacgcugguggagccgggcgacaagaucaccuucgaggcgaccggcaaccucgucgcgccccgguacgccuucgcccugaagcgcaacagcggguccggcaucaucaucagcgacaccuccgugcacgacugcgacacgaccugccagacccccaacggggccaucaacaccagccugcccuuccagaacauccacccggugacgaucggcgagugccccaaguacgucaaguccaccaagcuccggauggccaccggccugcgcaacauccccagcauccagucccgggggcuguucggcgccaucgccggguucaucgagggcggguggaccggcaugaucgacggcugguacggguaccaccaccagaacgagcagggcagcggguacgccgccgaccucaaguccacgcagaacgcgaucgacggcaucaccaacaaggugaacagcgugaucgagaagaugaacacccaguucaccgccgucgggaaggaguucucccaccuggagcgccggaucgagaaccugaacaagaagguggacgacggcuuccucgacaucuggacguacaacgccgagcugcugguccuccuggagaacgagcgcacccuggacuaccacgacagcaacgugaagaaccucuacgagaaggugcggucccagcugaagaacaacgccaaggagaucggcaacgggugcuucgaguucuaccacaagugcgacgacaugugcauggagagcgucaagaacggcaccuacgacuaccccaaguacuccgaggaggccaagcugaaccgcgaggagaucgacggggugaagcucgagagcacccggaucuaccagauccuggcgaucuacagcacgguggccuccagccugguccucguggugucccugggcgccaucagcuucuggaugugcuccaacgggagccugcagugccgcaucuga

SEQ ID NO: 74905 - RNA, 1701 nt, Artificial Sequence; identical to SEQ ID NO: 73449
  derived and/or modified sequence opt1 from hemagglutinin__InfluenzaA__EPI564139

SEQ ID NO: 74906 - RNA, 1701 nt, Artificial Sequence; identical to SEQ ID NO: 74694
  derived and/or modified sequence opt1 from hemagglutinin__InfluenzaA__EPI786706

SEQ ID NO: 74907 - RNA, 1701 nt, Artificial Sequence
  derived and/or modified sequence opt1 from hemagglutinin__InfluenzaA__EPI395313
augaaggccauccugaucgugcuccuguacaccuucaccacggccaacgcggacacccugugcaucggcuaccacgccaacaacagcaccgacaccgucgacacggugcucgagaagaacgugaccgucacccacuccgugaaccugcuggagaaccgccacaacgggaagcucugcaagcugcggggcguggcgccccugcaccucgggaagugcaacaucgccggcuggcugcuggggaacccggagugcgagagccucuccaccgccagcuccuggagcuacaucgucgagacguccaacagcgacaacgggaccugcuaccccggcgacuucaucaacuacgaggagcugcgcgagcagcuguccagcguguccagcuucgagcgguucgagaucuuccccaagaccuccagcuggcccaaccacgacaccaaccgcggcgugacggccgccugcccgcacgccggcaccaaguccuucuacaagaaccucaucuggaucgccaagaaggggaacagcuaccccaagaucaacaaguccuacaucaacaacaaggagaaggagguccuggugcugugggcgauccaccaccccagcaccuccgccgaccagcagagccucuaccagaacgccgacgccuacguguucgucggcagcucccgguacagccgcaaguucgagcccgagaucgccacccggccgaaggugcgcgaccaggcggggcggaugaacuacuacuggacgcugguggagcccggcgacaagaucaccuucgaggccaccggcaaccuggucgcgccccgcuacgccuucgcccucaagcggaacuccgggagcggcaucaucaucuccgacaccagcgugcacgacugcgacacgaccugccagacccccaacggggccaucaacaccucccugccguuccagaacauccaccccgugacgaucggcgagugccccaaguacgucaagagcaccaagcugcgcauggccaccggccuccggaacauccccuccauccagagccgcgggcuguucggcgccaucgccggguucaucgagggcggguggaccggcaugaucgacggcugguacggguaccaccaccagaacgagcagggcuccggguacgccgcggaccucaagagcacgcagaacgccaucgacggcaucaccaacaaggugaacuccgugaucgagaagaugaacacccaguucaccgccgucgggaaggaguucagccaccuggagcggcgcaucgagaaccugaacaagaagguggacgacggcuuccuggacaucuggacguacaacgccgagcuccuggugcugcucgagaacgagcggacccuggacuaccacgacuccaacgucaagaaccuguacgagaaggugcgcagccagcucaagaacaacgccaaggagaucggcaacgggugcuucgaguucuaccacaagugcgacgacaugugcauggaguccgucaagaacggcaccuacgacuacccgaaguacagcgaggaggcgaagcugaaccgggaggugaucgacggggugaagcuggaguccacccgcaucuaccagauccucgccaucuacgccacggucgccagcagccuggugcugguggucucccucggcgcgaucagcuucuggaugugcuccaacgggagccugcagugccggaucugcaucuga

SEQ ID NO: 74908 - RNA, 1701 nt, Artificial Sequence
  derived and/or modified sequence opt1 from hemagglutinin__InfluenzaA__EPI291696
augaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgagaaccgccacaacgggaagcugugcaagcugcggggcgugcccccgcuccaccuggggaagugcaacaucgccggcuggcugcucgggaaccccgagugcgagcugcuguucaccgccagcuccuggagcuacaucgucgagaccuccaacagcgacaacggcacgugcuaccccggcgacuucaucaacuacgaggagcuccgcgagcagcuguccagcguguccagcuucgagcgguucgagaucuuccccaaggcguccagcuggccggaccacgagaccaaccgcggggugaccgccgccugccccuacgccggcgcgaacuccuucuaccggaaccugaucuggcucgucaagaaggggaacagcuaccccaagcuguccaagagcuacgugaacaacaaggagaaggaggugcugguccucuggggcauccaccacccgcccaccuccacggaccagcagagccuguaccagaacgccgacgccuacguguucgugggguccagcaaguacaacaagaaguucaagcccgagauggccgcccgccccaagguccggggccaggcgggccgcaugaacuacuacuggacccugguggcccccggggacaccaucaccuucgaggccacgggcaaccucguggucccgcgguacgccuucgccaugaagcgcgggagcggcuccggcaucaucaucagcgacacccccgugcacgacugcaacacgaccugccagacccccaagggggcgaucaacaccucccugcccuuccagaacauccacccggugaccaucggcgagugccccaaguacgucaagagcaccaagcugcggauggccacggggcuccgcaacauccccuccauccagagccggggccuguucggggccaucgccggcuucaucgagggcggguggaccggcaugaucgacgggugguacggcuaccaccaccagaacgagcagggguccggcuacgccgcggaccgcaagagcacccagaacgccaucgacggcaucaccaacaaggugaacuccgugaucgagaagaugaacacgcaguucaccgccgucgggaaggaguucaaccaccuggagaagcggaucgagaaccucaacaagaagguggacgacggcuuccuggacgucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacgacacgugcauggagagcgugaagaacgggaccuacgacuaccccaaguacuccgaggagagcaagcucaaccgcgaggagaucgacggcgugaagcuggaguccacccggaucuaccagauccuggcgaucuacagcaccgucgccuccagccucgugcuguccgugagccugggcgccaucagcuucuggaugugcuccaacgggagccuccagugccgcaucugcaucuga

SEQ ID NO: 74909 - RNA, 1701 nt, Artificial Sequence; identical to SEQ ID NO: 70839
  derived and/or modified sequence opt1 from hemagglutinin__InfluenzaA__ACU80014

SEQ ID NO: 74910 - RNA, 1701 nt, Artificial Sequence; identical to SEQ ID NO: 63677
  derived and/or modified sequence opt1 from hemagglutinin__InfluenzaA__EPI177400

SEQ ID NO: 74911 - RNA, 1701 nt, Artificial Sequence; identical to SEQ ID NO: 64120
  derived and/or modified sequence opt1 from hemagglutinin__InfluenzaA__ACT36512

SEQ ID NO: 74912 - RNA, 1704 nt, Artificial Sequence
  derived and/or modified sequence opt1 from hemagglutinin__InfluenzaA__AJE30344
auggagaagaucgugcugcuccuggccgucaucagccuggugaaguccgaccagaucugcaucggcuaccacgccaacaacagcaccaagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggacccugaacgacuacgaggagcucaagcaccuccugucccgcaucaaccacuucgagaagaaccugaucaucccgcggagcuccuggcccaaccacgagacgagccugggcgucuccgccgcgugccccuaccagggcgccagcuccuucuuccgcaacgugguguggcugaucaagaagaacgacgccuaccccaccaucaagaucagcuacaacaacaccaaccgggaggaccuccugauccugugggggauccaccacuccaacaacgccgcggagcagaccaaccucuacaagaacccggacacguacgucagcgugggcaccuccacccugaaccagcgccuggugcccaagaucgccacccggagccaggucaacgggcaguccggccgcauggacuucuucuggacgauccucaagcccaacgacgccauccacuucgagagcaacgggaacuucaucgcccccgaguacgccuacaagaucgugaagaagggcgacuccaccaucaugaaguccgagauggaguacggccacugcaacaccaagugccagaccccgaucggggcgaucaacagcagcaugcccuuccacaacauccacccccugacgaucggcgagugccccaaguacgucaagagcaacaagcuggugcucgccaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgcggacaaggagagcacccagaaggccaucgacggcgugaccaacaaggucaacuccaucaucgacaagaugaacacgcaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuaccccaaguacagcgaggaggcgauccucaagcgcgaggagaucuccggggugaagcuggagagcaucggcacguaccagauccuguccaucuacagcaccgucgccuccagccucgcccuggccaucaucguggccgggcugucccucuggaugugcagcaacggcucccugcagugccgcaucugcaucuga

SEQ ID NO: 74913 - RNA, 1701 nt, Artificial Sequence; identical to SEQ ID NO: 74892
  derived and/or modified sequence opt1 from hemagglutinin__InfluenzaA__EPI178948

SEQ ID NO: 74914 - RNA, 1701 nt, Artificial Sequence; identical to SEQ ID NO: 74892
  derived and/or modified sequence opt1 from hemagglutinin__InfluenzaA__EPI178949

SEQ ID NO: 74915 - RNA, 1701 nt, Artificial Sequence
  derived and/or modified sequence opt1 from hemagglutinin__InfluenzaA__EPI590132
augaaggccauccugaucgugcuccuguacaccuucaccacggccaacgcggacaagaucugcaucggcuaccacgccaacaacagcaccgacaccgucgacaccgugcuggagaagaacgugacggucacccacuccgugaaccuccuggagaacaagcacaacgggaagcugugcaagcuccgcggcguggcgccccugcaccuggggaagugcaacaucgccggcuggcuccuggggaacccggagugcgagagccuggccaccgccuccagcugguccuacaucgucgagaccagcuccagcaacaacggcacgugcuaccccggcgacuucaucaacuacgaggagcuccgggagcagcuguccagcguguccagcuucgagaaguucgagaucuuccccaagaccuccagcuggcccaaccacgagaccaacaagggggugaccgccgccugcccgcacgccggcacgaacuccuucuacaagaaccugaucuggcucgucaagaaggagaacagcuaccccaagaucaacaucuccuacaccaacaaccgcgggaaggaggugcuggugcugugggcgauccaccacccgcccaccagcaccgaccagcagucccucuaccagaacgccaacagcuacgucuucgugggcagcucccgguacagccgcaaguucgagcccgagaucgccacgcggcccaaggugcgcgggcaggccggccggaugaacuacuacuggacccuggucgagcccggcgacaagaucaccuucgaggccaccgggaaccugguggugccccgcuacgcguucgcccucaagcggaacuccggcagcgggaucaucaucuccgagacgccgguccacgacugcgacacgaccugccagacccccaacggcgccaucaacaccagccugcccuuccagaacauccaccccgugaccaucggcgagugcccgaaguacgugaaguccaccaagcugcgcauggccaccgggcuccggaacauccccagcauccagucccgcggccuguucggggccaucgcgggcuucaucgagggcggguggacgggcaugaucgacgggugguacggcuaccaccaccagaacgagcaggggagcggcuacgccgccgaccugaaguccacccagaacgccaucgacgggaucaccaacaaggucaacagcgugaucgagaagaugaacacccaguucacggccgugggcaaggaguucucccaccucgagcggcgcaucgagaaccugaacaagaaggucgacgacggcuucaucgacaucuggaccuacaacgcggagcugcucgugcugcuggagaacgagcggacccucgacuaccacgacagcaacgucaagacccuguacgagaaggugcgcucccagcugaagaacaacgccaaggagaucgggaacggcugcuucgaguucuaccacaagugcgacgacacgugcauggagagcgugaagaacgggaccuacgacuaccccaaguacuccgaggaggccaagcucaaccgggaggagaucgacggcaucaagcuggagagcacccgcaucuaccagauccuggccaucuacuccaccgucgccagcagccucgugcugguggucucccugggggcgaucagcuucuggaugugcuccaacggcagccuccagugccgggugugcaucuga

SEQ ID NO: 74916 - RNA, 1701 nt, Artificial Sequence; identical to SEQ ID NO: 62744
  derived and/or modified sequence opt1 from hemagglutinin__InfluenzaA__ABU80400

SEQ ID NO: 74917 - RNA, 1698 nt, Artificial Sequence
  derived and/or modified sequence opt1 from hemagglutinin__InfluenzaA__ABO21709
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacaaccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 74918 - RNA, 1701 nt, Artificial Sequence; identical to SEQ ID NO: 63664
  derived and/or modified sequence opt1 from hemagglutinin__InfluenzaA__CAZ65588

SEQ ID NO: 74919 - RNA, 1701 nt, Artificial Sequence; identical to SEQ ID NO: 74694
  derived and/or modified sequence opt1 from hemagglutinin__InfluenzaA__EPI697744

SEQ ID NO: 74920 - RNA, 1701 nt, Artificial Sequence; identical to SEQ ID NO: 74854
  derived and/or modified sequence opt1 from hemagglutinin__InfluenzaA__EPI768525

SEQ ID NO: 74921 - RNA, 1701 nt, Artificial Sequence
  derived and/or modified sequence opt1 from hemagglutinin__InfluenzaA__EPI726930
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaaggcguccagcuggcccaaccacgacuccaacaagggcgucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccaccacggccgaccagcagagccuguaccagaacgccgacgccuacguguucgugggcaccagccgguacuccaagaaguucaagcccgagaucgccacccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucuccuucuggaugugcagcaacggcagccugcagugccggaucugcaucuga

SEQ ID NO: 74922 - RNA, 1701 nt, Artificial Sequence
  derived and/or modified sequence opt1 from hemagglutinin__InfluenzaA__EPI813817
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccaacagcgacaacgggaccugcuaccccggcgacuucaucaacuacgaggagcuccgggagcagcuguccagcguguccagcuucgagcgcuucgagaucuuccccaaggcguccagcuggcccaaccacgacuccaacaagggggucaccgccgccugcccgcacgccggcgccaagagcuucuacaagaaccugaucuggcucgugaagaaggggaacuccuaccccaagcugaaccagagcuacaucaacgacaagggcaaggaggugcugguccucugggggauccaccaccccuccaccacggccgaccagcagagccuguaccagaacgccgacgccuacguguucgugggcaccagccgguacuccaagaaguucaagcccgagaucgccacccgcccgaagguccgggaccaggaggcgcgcaugaacuacuacuggacccugguggagcccggcgacaagaucacguucgaggccaccgggaaccucguggucccccgguacgccuucaccauggagcgcaacgccggcagcgggaucaucaucuccgacacccccgugcacgacugcaacacgaccugccagaccccggagggcgccaucaacaccagccugcccuuccagaacauccaccccaucacgaucggcaagugccccaaguacgugaaguccaccaagcugcggcucgcgaccgggcugcgcaacgucccgagcauccagucccggggccuguucggggccaucgccggcuucaucgagggcggcuggaccggcaugguggacgggugguacggcuaccaccaccagaacgagcaggggagcggcuacgccgccgaccucaaguccacgcagaacgcgaucgacaagaucaccaacaaggugaacagcgucaucgagaagaugaacacccaguucaccgccguggggaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggagaagaucgacggggugaagcucgagagcacccgcaucuaccagauccuggcgaucuacuccaccgucgccagcucccuggugcucguggucagccugggcgccaucuccuucuggaugugcagcaacgggagccugcagugccggaucugcaucuga

SEQ ID NO: 74923 - RNA, 1701 nt, Artificial Sequence
  derived and/or modified sequence opt1 from hemagglutinin__InfluenzaA__EPI466626
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcuccguggugcuggucgugagccucggggccaucagcuucuggaugugcuccaacggcagccugcagugccggaucugcaucuga

SEQ ID NO: 74924 - RNA, 1701 nt, Artificial Sequence
  derived and/or modified sequence opt1 from hemagglutinin__InfluenzaA__EPI541966
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgagagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcuccguggugcuggucgugagccucggggccaucagcuucuggaugugcuccaacggcagccugcagugccggaucugcaucuga

SEQ ID NO: 74925 - RNA, 1701 nt, Artificial Sequence
  derived and/or modified sequence opt1 from hemagglutinin__InfluenzaA__EPI652003
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgagagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccacccgcccaccacggccgaccagcagagccuguaccagaacgccgacgccuacguguucgugggcaccucccgguacagcaagaaguucaagcccgagaucgccauccgccccaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucagcgacaccccggugcacgacugcaacaccacgugccagacccccgagggcgccaucaacaccucccugcccuuccagaacauccaccccaucaccaucgggaagugcccgaaguacgucaagagcacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagcguggugcuggucgugucccucggggccaucagcuucuggaugugcagcaacggcucccugcagugccggaucugcaucuga

SEQ ID NO: 74926 - RNA, 1701 nt, Artificial Sequence
  derived and/or modified sequence opt1 from hemagglutinin__InfluenzaA__EPI291877
augaaggccaucaucgugguccugcucuacaccuucgccaccgcggacgccgacacgcugugcaucggcuaccacgccaacaacagcaccgacaccguggacaccgugcuggagaagaacgucacggugacccacuccgugaacauccucgagaacaagcacgacgggaagcugugcaagcugcgcggcgucgcgccccuccaccuggggaagugcaacaucgccggcuggcugcucgggaacccggagugcgagagccuguucgccgccuccagcugguccuacaucguggagacccccaacagcgacaacgggaccugcuaccccggcgacuucaucaacuacgaggagcugcgggagcaccucuccagcguguccagcuucgagcgcuucgagaucuuccccaaggccaacuccuggccgaaccacgacacgaacaagggcgucaccgccgcgugccccuacgccggcgccaacagcuucuaccggaaccugaucuggcuggugaagaaggggaacuccuaccccaagcucagcaaguccuacaucaacaacaagaagaaggaggugcuggucaucuggggcauccaccacccgcccaccagcaucgaccagcagacccuguaccagaacgccgacgccuacguguucgugggguccagcaaguacuccaagcgcuucaagcccgagaucgcggcccggcccaagguccgcgaccaggccggccggauggacuacuacuggacgcucaucgagcccggcgacaccaucaccuucgaggccaccgggaaccugguggugccgcgcuacgccuucgcgaugaagcggggcagcgggagcggcaucaucgucuccgacgcccccgugcacgacugcaacacgaccugccagacccccaagggcgccaucaacaccagccugcccuuccagaacauccacccggugacgaucggggagugccccaaguacgucaaguccaccaagcuccgcauggccaccggccugcggaacauccccagcauccagucccgcgggcuguucggcgccaucgcgggguucaucgagggcggcuggaccgggaugaucgacggcugguacggguaccaccaccagaacgagcagggcagcggguacgccgccgaccagaaguccacgcagaacgccaucgacggcaucaccaacaaggugaacagcaucaucgagaagaugaacacccaguucaccgccgugggcaaggaguucucccagcucgagaagcggaucgagagccugaacaacaaggucgacgacggguuccuggacaucuggacguacaacgcggagcuccuggugcugcucgagaacgagcgcacccuggacuaccacgacuccaacgucaagaaccuguacgagaaggugcggagccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacgggaucaagcuggaguccgcccggaucuaccagauccucgcgaucuacagcaccgucgccuccagccuggugcugcucgugucccugggcgccgucagcuucuggaugugcagcaacggcucccugcagugccgcaucugcaucuga

SEQ ID NO: 74927 - RNA, 1701 nt, Artificial Sequence
  derived and/or modified sequence opt1 from hemagglutinin__InfluenzaA__ABR29595
augaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugcggggcguggcgccccuccaccuggggaagugcaacaucgccggcuggcugcucgggaacccggagugcgagcugcuguucaccgccagcuccuggagcuacaucgucgagaccuccaacagcgacaacggcacgugcuaccccggcgacuucaucaacuacgaggagcuccgcgagcagcuguccagcguguccagcuucgagcgguucgagaucuuccccaaggccuccagcuggcccaaccacgagaccaaccgcggggugaccgccgccugcccguacgcgggcgccaacuccuucuaccggaaccugaucuggcucgucaagaaggggaacagcuaccccaagcuguccaagagcuacgugaacaacaaggagaaggaggugcugguccucuggggcauccaccacccgcccaccuccacggaccagcagagccuguaccagaacgccgacgccuacguguucgugggguccagcaaguacaacaagaaguucaagcccgagaucgccacccgccccaagguccggggccaggcgggccgcaugaacuacuacuggacccugguggagcccggggacaccaucacguucgaggccaccggcaaccucguggucccccgguacgccuucgccaugaagcgcgggagcggcuccggcaucaucaucagcgacaccccggugcacgacugcaacaccacgugccagacccccaagggggccaucaacaccucccugcccuuccagaacauccaccccgugaccaucggcgagugcccgaaguacgucaagagcacgaagcugcggauggcgaccgggcuccgcaacauccccuccauccagagccggggccuguucggggccaucgccggcuucaucgagggcggguggaccggcaugaucgacgggugguacggcuaccaccaccagaacgagcagggguccggcuacgccgccgaccgcaagagcacccagaacgcgaucgacggcaucacgaacaaggugaacuccgugaucgagaagaugaacacccaguucaccgccgucgggaaggaguucaaccaccuggagaagcggaucgagaaccucaacaagaagguggacgacggcuuccuggacgucuggaccuacaacgccgagcugcucgugcugcuggagaacgagcgcacgcucgacuaccacgacagcaacgugaagaaccuguacgagaagguccggucccagcugaagaacaacgccaaggagaucgggaacggcugcuucgaguucuaccacaagugcgacgacacgugcauggagagcgugaagaacgggaccuacgacuaccccaaguacuccgaggagagcaagcucaaccgcgaggagaucgacggcgugaagcuggaguccacccggaucuaccagauccuggccaucuacagcaccgucgcguccagccucgugcugcuggugucccucggcgccaucagcuucuggaugugcagcaacgggucccugcagugccgcaucugcaucuga

SEQ ID NO: 74928 - RNA, 1701 nt, Artificial Sequence
  derived and/or modified sequence opt1 from hemagglutinin__InfluenzaA__EPI291885
augaaggccaucaucgugguccugcuccacaccuucgccaccgcggacgccgacacccugugcaucggcuaccacgccaacaacagcaccgacaccguggacaccgugcuggagaagaacgucacggugacccacuccgugaaccuccuggagaccaagcacgacgggaagcugugcaaccucaagggcgucgcgccccugcaccuggggaagugcaacaucgccggcuggcuccuggggaacccggagugcgagagccuguucaccgccuccagcugguccuacaucguggagacgcccaacagcgacaacgggaccugcuaccccggcaacuucaucaacuacgaggagcuccgcgagcaccuguccagcguguccagcuucgagcgguucgagaucuuccccaaggccaacuccuggccgaaccacgacaccaacaagggggucaccgccgccugccccuacgcgggcgccaacagcuucuaccgcaaccugaucuggcucgugaagaaggggaacuccuaccccaagcugagcaaguccuacaucaacaacaagaagaaggaggugcuggucaucuggggcauccaccacccgcccacgagcaccgaccagcagacccucuaccagaacgccgacgccuacguguucgugggguccagcaaguacuccaagcgguucgagcccgagaucgccgcgcgccccaagguccggaaccaggccggccgcaugaacuacuacuggacccugaucgagcccggcgacacgaucaccuucgaggccaccgggaaccugguggugccgcgguacgccuucgccaugcgccggggcagcgggagcggcaucaucgucuccgacgcgcccgugcacgacugcaacaccacgugccagacccccaagggcgccaucaacaccagccuccccuuccagaacauccacccggugaccaucggggagugccccaaguacgucaaguccacgaagcugcgcauggccaccggccugcggaacauccccagcauccagucccgcggccucuucggcgccaucgccggguuccuggagggcggcuggaccgggaugaucgacggcugguacggguaccaccaccagaacgagcagggcagcggguacgcggccgaccagaaguccacccagaacgccaucgacggcaucacgaacaaggugaacagcaucaucgagaagaugaacacccaguucaccgccgugggcaaggaguucucccagcuggagaagcggaucgagagccucaacaacaaggucgacgacggguuccuggacaucuggaccuacaacgccgagaugcuggugcuccuggagaacgagcgcacgcuggacuaccacgacuccaacgucaagaaccucuacgagaaggugcggagccagcugaagaacaacgcgaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggucaagcucgaguccgcccggaucuaccagauccuggccaucuacagcaccguggcguccagccuggugcuccuggucucccugggcgccgugagcuucuggaugugcagcaacggcucccuccagugccgcaucugcaucuga

SEQ ID NO: 74929 - RNA, 1701 nt, Artificial Sequence; identical to SEQ ID NO: 63664
  derived and/or modified sequence opt1 from hemagglutinin__InfluenzaA__EPI176515

SEQ ID NO: 74930 - RNA, 1701 nt, Artificial Sequence; identical to SEQ ID NO: 64120
  derived and/or modified sequence opt1 from hemagglutinin__InfluenzaA__EPI189182

SEQ ID NO: 74931 - RNA, 1701 nt, Artificial Sequence; identical to SEQ ID NO: 63912
  derived and/or modified sequence opt1 from hemagglutinin__InfluenzaA__EPI180574

SEQ ID NO: 74932 - RNA, 1701 nt, Artificial Sequence; identical to SEQ ID NO: 69717
  derived and/or modified sequence opt1 from hemagglutinin__InfluenzaA__EPI377499

SEQ ID NO: 74933 - RNA, 1701 nt, Artificial Sequence
  derived and/or modified sequence opt1 from hemagglutinin__InfluenzaA__EPI346916
augaaggccauccuggugguccuccuguacaccuucaccacggccaccgcggacacccugugcaucggcuaccacgccaacaacagcaccgacacgguggacaccgugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagagccucuccacggccagcuccuggagcuacaucguggagaccuccaacagcgacaacgggaccugcuaccccggcgacuucaucaacuacgaggagcugcgcgagcagcuguccagcguguccagcuucgagcgguucgagaucuuccccaagaccuccagcuggcccaaccacgacacgaaccgcggcgucaccgccgccugcccgcacgacggcaccaacuccuucuaccggaaccucaucuggcuggugaagaaggggaacagcuaccccaagaucaacaaguccuacaucaacaacaaggagaaggagauccuggugcucugggccauccaccaccccagcaccuccgccgaccagcagagccuguaccagaacgcggacgccuacgucuucgugggcagcucccgcuacagccggaaguucgagcccgagguggccacgcgcccgaagguccgggaccaggccgggcgcaugaacuacuacuggacccugguggagcccggcgacaagaucaccuucgaggccaccggcaaccucguggucccccgguacgcguucgcccugaagcgcaacuccgggagcggcaucaucaucuccgacacgagcgugcacgacugcgacaccaacugccagacccccaacggggccaucaacaccucccugccguuccagaacauccaccccgugacgaucggcgagugccccaaguacgucaagagcaccaagcuccggauggccaccggccugcgcaacauccccuccauccagagccgggggcuguucggcgccaucgcgggguucaucgagggcggguggaccggcaugaucgacggcugguacggguaccaccaccagaacgagcagggcuccggguacgccgccgaccucaagagcacgcagaacgccaucgacggcaucaccaacaaggugaacuccgugaucgagaagaugaacacccaguucaccgccgucgggaaggaguucagccaccuggagcgccggaucgagaaccugaacaagaagguggacgacggcuuccucgacaucuggacguacaacgcggagcugcugguccuccuggagaacgagcgcacccuggacuaccacgacuccaacgugaagaaccucuacgagaaggugcggagccagcugaagaacaacgccaaggagaucggcaacgggugcuucgaguucuaccacaagugcgacgacaugugcauggaguccgucaagaacggcaccuacgacuacccgaaguacagcgaggaggccaagcugaaccgcgaggagaucgacggggugaagcucgaguccacccggaucuaccagauccuggccaucuacagcacgguggccagcucccugguccucguggugagccugggcgcgaucuccuucuggaugugcagcaacgggucccugcagugccgcaucugcaucuga

SEQ ID NO: 74934 - RNA, 1689 nt, Artificial Sequence; identical to SEQ ID NO: 64291
  derived and/or modified sequence opt1 from hemagglutinin__InfluenzaA__ACV49600

SEQ ID NO: 74935 - RNA, 1701 nt, Artificial Sequence; identical to SEQ ID NO: 63337
  derived and/or modified sequence opt1 from hemagglutinin__InfluenzaA__BAF48361

SEQ ID NO: 74936 - RNA, 1701 nt, Artificial Sequence
  derived and/or modified sequence opt1 from hemagglutinin__InfluenzaA__EPI507594
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcaagcgggggagcaacuccagcuucuucucccgccugaacuggcucacccaccugaacuucaaguaccccgcgcugaacgugaccaugcccaacaacgagcaguucgacaagcucuacaucuggggcguccaccaccccgugacggacaaggaccagaucuuccuguacgcccagagcuccgggcggaucaccgugagcaccaagcgcagccagcaggccgucaucccgaacaucggcuuccggccccgcauccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucaccuacggggcgugcccccgguacgucaagcagagcacccugaagcucgccacgggcaugcgcaacgugcccgagaagcagacccgggggaucuucggcgccaucgccggguucaucgagaacggcugggagggcaugguggacgggugguacggcuuccgccaccagaacuucgaggggcggggccaggccgcggaccugaaguccacccaggccgccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 74937 - RNA, 1701 nt, Artificial Sequence
  derived and/or modified sequence opt1 from hemagglutinin__InfluenzaA__EPI461953
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacuucgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 74938 - RNA, 1701 nt, Artificial Sequence
  derived and/or modified sequence opt1 from hemagglutinin__InfluenzaA__EPI461953/m1
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcaagcgggggagcaacuccagcuucuucucccgccugaacuggcucacccaccugaacuucaaguaccccgcgcugaacgugaccaugcccaacaacgagcaguucgacaagcucuacaucuggggcguccaccaccccgugacggacaaggaccagaucuuccuguacgcccagagcuccgggcggaucaccgugagcaccaagcgcagccagcaggccgucaucccgaacaucggcuaccggccccgcauccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucaccuacggggcgugcccccgguacgucaagcagagcacccugaagcucgccacgggcaugcgcaacgugcccgagaagcagacccgggggaucuucggcgccaucgccggguucaucgagaacggcugggagggcaugguggacgggugguacggcuuccgccaccagaacuucgaggggcggggccaggccgcggaccugaaguccacccaggccgccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 74939 - RNA, 1701 nt, Artificial Sequence
  derived and/or modified sequence opt1 from hemagglutinin__InfluenzaA__EPI668105
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgggggagcuccagcuccuucuucagccgccugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcggccggaucaccgugagcaccaagcgcucccagcaggccgugauccccaacaucggcagccggccccgcauccgggggauccccucccgcaucagcaucuacuggacgaucgucaagccgggcgacauccuccugaucaacuccaccgggaaccugaucgcgccccggggcuacuucaagauccgcagcggcaaguccagcaucaugcgguccgacgcccccaucgggaagugcaagagcgagugcaucacccccaacggcuccaucccgaacgacaagcccuuccagaacgugaaccgcaucaccuacggggccugcccccgguacgugaagcacagcacgcucaagcuggccaccggcaugcgcaacguccccgagaagcagacccgggggaucuucggcgccaucgccggcuucaucgagaacgggugggagggcaugguggacgggugguacggcuuccgccaccagaacuccgaggggcggggccaggccgccgaccucaagagcacccaggcggccaucgaccagaucaacggcaagcugaaccgccugaucgggaagacgaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggcgucgagcugaaguccggguacaaggacuggauccucuggaucagcuucgccaucagcugcuuccugcugugcguggcccuccugggcuucaucaugugggccugccagaaggggaacauccggugcaacaucugcaucuga

SEQ ID NO: 74940 - RNA, 1701 nt, Artificial Sequence
  derived and/or modified sequence opt1 from hemagglutinin__InfluenzaA__EPI578446
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaccgugagcaccaagcggucccagcaggccgugauccccaacaucggcagccgcccccggauccgcggcauccccucccggaucagcaucuacuggacgaucgucaagccgggggacauccuccugaucaacuccaccggcaaccugaucgcgccccgcggguacuucaagauccggagcggcaaguccagcaucaugcgcuccgacgcccccaucggcaagugcaagagcgagugcaucacccccaacggguccaucccgaacgacaagcccuuccagaacgugaaccggaucaccuacggcgccugcccccgcuacgugaagcacagcacgcucaagcuggccaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagacgaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcagcauccggaacgggaccuacgaccacaacguguaccgcgacgaggcccugaacaaccgguuccagaucaagggcgucgagcugaaguccggcuacaaggacuggauccucuggaucagcuucgccaucagcugcuuccugcugugcguggcccuccugggguucaucaugugggccugccagaagggcaacauccgcugcaacaucugcaucuga

SEQ ID NO: 74941 - RNA, 1701 nt, Artificial Sequence; identical to SEQ ID NO: 73449
  derived and/or modified sequence opt1 from hemagglutinin__InfluenzaA__EPI551882

SEQ ID NO: 74942 - RNA, 1701 nt, Artificial Sequence
  derived and/or modified sequence opt1 from hemagglutinin__InfluenzaA__EPI344389
augaagaccaucaucgccuucagcugcauccugugccucaucuucgcccagaagcugcccggcuccgacaacagcauggcgacccugugccucgggcaccacgccgugccgaacggcacgcuggucaagaccaucaccgacgaccagaucgaggugaccaacgccacggagcuggugcaguccagcuccaccgggcgcaucugcaacagcccccaccagauccucgacggcaagaacugcacccugaucgacgcccugcucggggacccccacugcgacgaccugcagaacaaggagugggaccuguucgucgagcgguccaccgccuacagcaacugcuaccccuacuacgugccggacuacgcgacgcuccgcucccugguggccagcuccggcaaccuggaguucacccaggagagcuucaacuggaccggcgucgcccaggacggguccagcuacgccugccggcgcggcuccgugaacagcuucuucucccggcucaacuggcuguacaaccugaacuacaaguaccccgagcagaacgugaccaugcccaacaacgacaaguucgacaagcucuacaucuggggcguccaccaccccgggacggacaaggaccagaccaaccuguacgugcaggcgagcgggcgcgugaucgucuccaccaagcggagccagcagaccgugaucccgaacaucggcagccgccccugggugcggggcgucuccagcaucaucuccaucuacuggacgaucgugaagcccggggacauccugcucaucaacagcaccggcaaccugaucgcgccccgcggguacuucaagauccaguccggcaagagcuccaucaugcggagcgacgcccacaucgacgagugcaacuccgagugcaucaccccgaacggcagcauccccaacgacaagcccuuccagaacgugaacaagaucaccuacggggccugcccccgcuacgucaagcagaacacgcugaagcucgccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgccgaccucaagagcacgcaggccgcgaucaaccagaucaccgggaagcugaaccgcgucaucaagaagaccaacgagaaguuccaccagaucgagaaggaguucuccgagguggagggccggauccaggaccucgagaaguacguggaggacaccaagaucgaccuguggagcuacaacgccgagcugcucgucgcccuggagaaccagcacacgaucgaccugaccgacuccgagaugagcaagcuguucgagcgcacccggcgccagcugcgggagaacgccgaggacaugggcaacgggugcuucaagaucuaccacaagugcgacaacgccugcaucggcuccauccgcaacgggaccuacgaccacgacaucuaccgcaacgaggcgcugaacaaccgguuccagaucaagggcgugcagcucaagagcggguacaaggacuggauccuguggaucuccuucgccaucagcugcuuccugcucugcgucgugcugcugggcuucaucaugugggccugccagaagggcaacauccgcugcaacaucugcaucuga

SEQ ID NO: 74943 - RNA, 1701 nt, Artificial Sequence
  derived and/or modified sequence opt1 from hemagglutinin__InfluenzaA__EPI348782
augaagaccaucaucgccuucagcugcauccugugccucaucuucgcccagaagcugcccggcuccgacaacagcauggcgacccugugccucgggcaccacgccgugccgaacggcacgcuggucaagaccaucaccgacgaccagaucgaggugaccaacgccacggagcuggugcaguccagcuccaccgggcgcaucugcaacagcccccaccagauccucgacggcaagaacugcacccugaucgacgcccugcucggggacccccacugcgacgaccugcagaacaaggagugggaccuguucgucgagcgguccaccgccuacagcaacugcuaccccuacuacgugccggacuacgcgacgcuccgcucccugguggccagcuccggcaaccuggaguucacccaggagagcuucaacuggaccggcgucgcccaggacggguccagcuacgccugccggcgcggcuccgugaacagcuucuucucccggcucaacuggcuguacaagcugaacuacaaguaccccgagcagaacgugaccaugcccaacaacgacaaguucgacaagcucuacaucuggggcguccaccaccccgggacggacaaggaccagaccaacaucuacgugcaggcgagcgggcgcgugaucgucuccaccaagcggagccagcagaccgugaucccgaacaucggcagccgccccugggugcggggcgucuccagcaucaucuccaucuacuggacgaucgugaagcccggggacauccugcugaucaacagcaccggcaaccucaucgcgccccgcggguacuucaagauccaguccggcaagagcuccaucaugcggagcgacgcccacaucgacgagugcaacuccgagugcaucaccccgaacggcagcauccccaacgacaagcccuuccagaacgugaacaagaucaccuacggggccugcccccgcuacgucaagcagaacacgcugaagcuggccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgccgaccucaagagcacgcaggccgcgaucaaccagaucaccgggaagcugaaccgcgucaucaagaagaccaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacacgaucgaccugaccgacuccgagaugagcaagcuguucgagcgcacccggcgccagcuccgggagaacgccgaggacaugggcaacgggugcuucaagaucuaccacaagugcgacaacgccugcaucggcuccauccgcaacgggaccuacgaccacgacaucuaccgcaacgaggcgcugaacaaccgguuccagaucaagggcgugcagcucaagagcggguacaaggacuggauccuguggaucuccuucgccaucagcugcuuccugcugugcgucgugcuccugggcuucaucaugugggccugccagaagggcaacauccgcugcaacaucugcaucuga

SEQ ID NO: 74944 - RNA, 1701 nt, Artificial Sequence
  derived and/or modified sequence opt1 from hemagglutinin__InfluenzaA__EPI642513
augaagaccaucaucgccuucagcugcauccugugccucaucuucgcccagaagcugcccggcuccgacaagagcauggcgacccugugccucgggcaccacgccgugccgaacggcacgcuggucaagaccaucaccgacgaccagaucgaggugaccaacgccacggagcuggugcaguccagcuccaccagccgcaucugcaacagcccccaccagauccucgacgggaagaacugcacccugaucgacgcccugcucggcgacccccacugcgacgacuuccagaacaagaagugggaccuguucgucgagcgguccaccgccuacuccaacugcuaccccuacuacgugccggacuacgcgacgcugcgcagccucaucgccuccagcgggaaccuggaguucacccaggaguccuucaacuggaccggcguggcccaggacggcagcuccuacgccugccggcgcgggagcgucaacuccuucuucagccggcugaacuggcucuacaaccugaacuacaaguaccccgagcagaacgugaccaugcccaacaacgacaaguucgacaagcuguacaucuggggcgugcaccaccccgggacggacaaggaccagaccaaccucuacguccaggcguccggccgcgugaucgugagcaccaagcggagccagcagaccgucaucccgaacaucgggucccgccccugggugcggggcgugagcuccaucaucagcaucuacuggacgaucgucaagcccggcgacauccugcugaucaacuccaccgggaaccucaucgcgccccgcggcuacuucaagauccagagcgggaaguccagcaucaugcgguccgacgcccacaucgacgagugcaacagcgagugcaucaccccgaacggcuccauccccaacgacaagcccuuccagaacgugaacaagaucaccuacggcgccugcccccgcuacgugaagcagaacacgcugaagcuggccaccgggaugcggaacgucccggagaagcagacccgcggcaucuucggggccaucgccggcuucaucgagaacgggugggagggcaugguggacggcugguacggguuccggcaccagaacagcgagggcaccgggcaggccgccgaccucaaguccacgcaggccgcgaucaaccagaucaccggcaagcugaaccgcgugaucaagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagauguccaagcuguucgagcgcacccggcgccagcuccgggagaacgccgaggacaugggcaacggcugcuucaagaucuaccacaagugcgacaacgccugcaucgggagcauccgcaacggcaccuacgaccacgacaucuaccgcaacgaggcgcugaacaaccgguuccagaucaaggggguccagcugaaguccggcuacaaggacuggauccucuggaucagcuucgccaucagcugcuuccugcugugcgugguccuccugggguucaucaugugggccugccagaagggcaacauccgcugcaacaucugcaucuga

SEQ ID NO: 74945 - RNA, 1701 nt, Artificial Sequence
  derived and/or modified sequence opt1 from hemagglutinin__InfluenzaA__EPI293965
augaagaccaucaucgccuucagcugcauccugugccucaucuucgcccagaagcugcccggcuccgacaacagcauggcgacccugugccucgggcaccacgccgugccgaacggcacgcuggucaagaccaucaccgacgaccagaucgaggugaccaacgccacggagcuggugcaguccagcuccaccgggcgcaucugcaacagcccccaccagauccucgacggcaagaacugcacccugaucgacgcccugcucggggacccccacugcgacgacuuccagaacaaggagugggaccuguucgucgagcgguccaccgccuacagcaacugcuaccccuacuacgugccggacuacgcgacgcugcgcucccucguggccagcuccggcaaccuggaguucacccaggagagcuucaacuggaccggcgucgcccaggacggguccagcuacgccugccggcgcggcuccgugaacagcuucuucucccggcugaacuggcucuacaaccugaacuacaaguaccccgagcagaacgugaccaugcccaacaacgacaaguucgacaagcuguacaucuggggcguccaccaccccgggacggacaaggaccagaccaaccucuacgugcaggcgagcgggcgcgugaucgucuccaccaagcggagccagcagaccgugaucccgaacaucggcagccgccccugggugcggggcgucuccagcaucaucuccaucuacuggacgaucgugaagcccggggacauccugcugaucaacagcaccggcaaccucaucgcgccccgcggguacuucaagauccaguccggcaagagcuccaucaugcggagcgacgcccacaucgacgagugcaacuccgagugcaucaccccgaacggcagcauccccaacgacaagcccuuccagaacgugaacaagaucaccuacggggccugcccccgcuacgucaagcagaacacgcugaagcuggccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgccgaccucaagagcacgcaggccgcgaucaaccagaucaccgggaagcugaaccgcgucaucaagaagaccaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacacgaucgaccugaccgacuccgagaugagcaagcuguucgagcgcacccggcgccagcuccgggagaacgccgaggacaugggcaacgggugcuucaagaucuaccacaagugcgacaacgccugcaucggcuccauccgcaacgggaccuacgaccacgacaucuaccgcaacgaggcgcugaacaaccgguuccagaucaagggcgugcagcucaagagcggguacaaggacuggauccuguggaucuccuucgccaucagcugcuuccugcugugcgucgugcuccugggcuucaucaugugggccugccagaagggcaacauccgcugcaacaucugcaucuga

SEQ ID NO: 74946 - RNA, 1701 nt, Artificial Sequence
  derived and/or modified sequence opt1 from hemagglutinin__InfluenzaA__EPI465400
augaagaccaucaucgccuucagcugcauccugugccucaucuucgcccagaagcugcccggcuccgacaacagcauggcgacccugugccucgggcaccacgccgugccgaacggcacgcuggucaagaccaucaccgacgaccagaucgaggugaccaacgccacggagcuggugcaguccagcuccaccgggcgcaucugcaacagcccccaccagauccucgacggcaagaacugcacccugaucgacgcccugcucggggacccccacugcgacgacuuccagaacaaggagugggaccuguucgucgagcgguccaccgccuacagcaacugcuaccccuacuacgugccggacuacgcgacgcugcgcucccucguggccagcuccggcaaccuggaguucacccaggagagcuucaacuggaccggcgucgcccaggacggguccagcuacgccugccggcgcggcuccgugaacagcuucuucucccggcugaacuggcucuacaaccugaacuacaaguaccccgagcagaacgugaccaugcccaacaacgacaaguucgacaagcuguacaucuggggcguccaccaccccgggacggacaaggaccagaccaagcucuacgugcaggcgagcgggcgcgugaucgucuccaccaagcggagccagcagaccgugaucccgaacaucggcagccgccccugggugcggggcgucuccagcaucaucuccaucuacuggacgaucgugaagcccggggacauccugcugaucaacagcaccggcaaccucaucgcgccccgcggguacuucaagauccaguccggcaagagcuccaucaugcggagcgacgcccacaucgacgagugcaacuccgagugcaucaccccgaacggcagcauccccaacgacaagcccuuccagaacgugaacaagaucaccuacggggccugcccccgcuacgucaagcagaacacgcugaagcuggccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgccgaccucaagagcacgcaggccgcgaucaaccagaucaccgggaagcugaaccgcgucaucaagaagaccaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacacgaucgaccugaccgacuccgagaugagcaagcuguucgagcgcacccggcgccagcuccgggagaacgccgaggacaugggcaacgggugcuucaagaucuaccacaagugcgacaacgccugcaucggcuccauccgcaacgggaccuacgaccacgacaucuaccgcaacgaggcgcugaacaaccgguuccagaucaagggcgugcagcucaagagcggguacaaggacuggauccuguggaucuccuucgccaucagcugcuuccugcugugcgucgugcuccugggcuucaucaugugggccugccagaagggcaacauccgcugcaacaucugcaucuga

SEQ ID NO: 74947 - RNA, 1701 nt, Artificial Sequence
  derived and/or modified sequence opt1 from hemagglutinin__InfluenzaA__EPI328898
augaagaccaucaucgccuucagcugcauccugugccucaucuucgcccagaagcugcccggcuccgacaacagcauggcgacccugugccucgggcaccacgccgugccgaacggcacgcuggucaagaccaucaccgacgaccagaucgaggugaccaacgccacggagcuggugcaguccagcuccaccgggcgcaucugcaacagcccccaccagauccucgacggcaagaacugcacccugaucgacgcccugcucggggacccccacugcgacgacuuccagaacaaggagugggaccuguucgucgagcgguccaccgccuacagcaacugcuaccccuacuacgugccggacuacgcgacgcugcgcucccucguggccagcuccggcaaccuggaguucacccaggagagcuucaacuggaccggcgucgcccaggacggguccagcuacgccugccggcgcggcuccgugaacagcuucuucucccggcugaacuggcucuacaaccugaacuacaaguaccccgagcagaacgugaccaugcccaacaacgacaaguucgacaagcuguacaucuggggcguccaccaccccgggacggacaaggaccagaccaagaucuacgugcaggcgagcgggcgcgugaucgucuccaccaagcggagccagcagaccgugaucccgaacaucggcagccgccccugggugcggggcgucuccagcaucaucuccaucuacuggacgaucgugaagcccggggacauccuccugaucaacagcaccggcaaccugaucgcgccccgcggguacuucaagauccaguccggcaagagcuccaucaugcggagcgacgcccacaucgacgagugcaacuccgagugcaucaccccgaacggcagcauccccaacgacaagcccuuccagaacgugaacaagaucaccuacggggccugcccccgcuacgucaagcagaacacgcucaagcuggccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgccgaccucaagagcacgcaggccgcgaucaaccagaucaccgggaagcugaaccgcgucaucaagaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugagcaagcuguucgagcgcacccggcgccagcugcgggagaacgccgaggacaugggcaacgggugcuucaagaucuaccacaagugcgacaacgccugcaucggcuccauccgcaacgggaccuacgaccacgacaucuaccgcaacgaggcgcucaacaaccgguuccagaucaagggcgugcagcucaagagcggguacaaggacuggauccuguggaucuccuucgccaucagcugcuuccugcugugcgucgugcugcucggcuucaucaugugggccugccagaagggcaacauccgcugcaacaucugcaucuga

SEQ ID NO: 74948 - RNA, 1701 nt, Artificial Sequence; identical to SEQ ID NO: 74947
  derived and/or modified sequence opt1 from hemagglutinin__InfluenzaA__EPI328900

SEQ ID NO: 74949 - RNA, 1701 nt, Artificial Sequence
  derived and/or modified sequence opt1 from hemagglutinin__InfluenzaA__EPI574644
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcaagaacugcacccugaucgacgcccugcucggggacccccagugcgacggcuuccagaacaagcggugggaccuguucguggagcgcuccaaggccuacagcaacugcuaccccuacgacgugccggacuacgcgucccugcggagccucgucgccuccagcggcacccuggaguucaacgacgaguccuucaacugggccggggugacgcagaacggcaccagcuccgccugcauccgcgggagcaacuccagcuucuucucccggcugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccacuccagcggccgcaucaccgugagcaccaagcggucccagcaggccgugaucccgaacaucggcagccgcccccggauccgcaacauccccucccggaucagcaucuacuggaccaucgucaagcccggggacauccugcugaucaacuccacgggcaaccucaucgccccgcgcggguacuucaagauccagagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcguggagcucaaguccggcuacaaggacuggauccuguggaucagcuucgccaucagcugcuuccugcucugcgucgcccugcugggguucaucaugugggcgugccagaagggcaacauccggugcaacaucugcaucuga

SEQ ID NO: 74950 - RNA, 1701 nt, Artificial Sequence
  derived and/or modified sequence opt1 from hemagglutinin__InfluenzaA__EPI563212
augaagaccaucaucgcccugagcuacauccucugccugguguucgcccagaagauccccggcaacgacaacaacaccgcgacgcugugccucgggcaccacgccgucccgaacggcaccaucgugaagaccaucaccaacgaccgcaucgaggugacgaacgccaccgagcugguccagaacuccagcaucggggagaucugcgacagcccccaccagauccuggacggcgagaacugcacccucaucgacgcccugcugggggacccccagugcgacggcuuccagaacaagaagugggaccucuucguggagcggagcaaggccuacuccaacugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcuccgggcgcaucaccgugagcaccaagcggagccagcaggccgugauccccaacaucggcucccgcccccggauccgcggcauccccagccggaucuccaucuacuggacgaucgucaagccgggggacauccuccugaucaacagcaccggcaaccugaucgcgccccgcggguacuucaagauccgguccggcaagagcuccaucaugcgcagcgacgcccccaucggcaagugcaaguccgagugcaucacccccaacgggagcaucccgaacgacaagcccuuccagaacgugaaccggaucaccuacggcgccugcccccgcuacgugaagcacuccacgcucaagcuggccaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcucaaccggcugaucggcaagacgaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcugaaguccggcuacaaggacuggauccucuggaucuccuucgccaucagcugcuuccugcugugcguggcccuccugggguucaucaugugggccugccagaagggcaacauccgcugcaacaucugcaucuga

SEQ ID NO: 74951 - RNA, 1701 nt, Artificial Sequence; identical to SEQ ID NO: 74950
  derived and/or modified sequence opt1 from hemagglutinin__InfluenzaA__EPI553999

SEQ ID NO: 74952 - RNA, 1701 nt, Artificial Sequence
  derived and/or modified sequence opt1 from hemagglutinin__InfluenzaA__EPI551570
augaagaccaucaucgcccugagcuacauccucugccugguguucgcccagaagauccccggcaacgacaacaacaccgcgacgcugugccucgggcaccacgccgucccgaacggcaccaucgugaagaccaucaccaacgaccgcaucgaggugacgaacgccaccgagcugguccagaacuccagcaucggggagaucugcgacagcccccaccagauccuggacggcgagaacugcacccucaucgacgcccugcugggggacccccagugcgacggcuuccagaacaagaagugggaccucuucguggagcggagcaaggccuacuccaacugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcuccgggcgcaucaccgugagcacgaagcggagccagcaggccgugaucccgaacaucggcucccgcccccggauccgcgacauccccagccggaucuccaucuacuggaccaucgucaagcccggcgacauccugcugaucaacagcaccgggaaccucaucgccccgcgcggcuacuucaagauccgguccgggaaguccuccaucaugcgcagcgacgcccccaucggcaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 74953 - RNA, 1701 nt, Artificial Sequence
  derived and/or modified sequence opt1 from hemagglutinin__InfluenzaA__EPI629738
augaagaccaucaucgcccugagcuacauccucugccugguguucgcccagaagauccccggcaacgacaacaacaccgcgacgcugugccucgggcaccacgccgucccgaacggcaccaucgugaagaccaucaccaacgaccgcaucgaggugacgaacgccaccgagcugguccagaacuccagcaucggggagaucugcgacagcccccaccagauccuggacggcgagaacugcacccucaucgacgcccugcugggggacccccagugcgacggcuuccagaacaagaagugggaccucuucguggagcggagcaaggccuacuccaacugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcuccgggcgcaucaucgugagcaccaagcggagccagcaggccgugauccccaacaucggcucccgcccccggauccgcgacauccccagccggaucuccaucuacuggaccaucgucaagccgggcgacauccuccugaucaacagcacggggaaccugaucgcgccccgcggcuacuucaagauccgguccgggaaguccuccaucaugcgcagcgacgcccccaucggcaagugcaaguccgagugcaucacccccaacggcagcaucccgaacgacaagcccuuccagaacgugaaccggaucaccuacggggccugcccccgcuacgugaagcacuccacccucaagcuggccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcucaaccggcugaucggcaagaccaacgagaaguuccaccagaucgagaaggaguucagcgagguggagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcacguacgaccacaacguguaccgcgacgaggcccugaacaaccgguuccagaucaagggggucgagcucaagagcggcuacaaggacuggauccuguggaucuccuucgccaucagcugcuuccugcugugcguggcccuccugggcuucaucaugugggccugccagaaggggaacauccgcugcaacaucugcaucuga

SEQ ID NO: 74954 - RNA, 1701 nt, Artificial Sequence
  derived and/or modified sequence opt1 from hemagglutinin__InfluenzaA__EPI631887
augaagaccaucaucgcccugagcuacauccucugccugguguucgcccagaagauccccggcaacgacaacaacaccgcgacgcugugccucgggcaccacgccgucccgaacggcaccaucgugaagaccaucaccaacgaccgcaucgaggugacgaacgccaccgagcugguccagaacuccagcaucggggagaucugcgacagcccccaccagauccuggacggcgagaacugcacccucaucgacgcccugcugggggacccccagugcgacggcuuccagaacaagaagugggaccucuucguggagcggagcaaggccuacuccaacugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcuccgggcgcaucaucgugagcaccaagcggagccagcaggccgugauccccaacaucggcucccgcccccggauccgcgacagccccucccggaucagcaucuacuggaccaucgucaagccgggcgacauccuccugaucaacuccacggggaaccugaucgcgccccgcggcuacuucaagauccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccucaagcuggccacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacccaggcggccaucgaccagaucaacgggaagcucaaccggcugaucggcaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 74955 - RNA, 1701 nt, Artificial Sequence
  derived and/or modified sequence opt1 from hemagglutinin__InfluenzaA__EPI577026
augaagaccaucaucgcccugagcuacauccucugccugguguucgcccagaagauccccggcaacgacaacaacaccgcgacgcugugccucgggcaccacgccgucccgaacggcaccaucgugaagaccaucaccaacgaccgcaucgaggugacgaacgccaccgagcugguccagaacuccagcaucggggagaucugcgacagcccccaccagauccuggacggcgagaacugcacccucaucgacgcccugcugggggacccccagugcgacggcuuccagaacaagaagugggaccucuucguggagcggagcaaggccuacuccaacugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcuccgggcgcaucaccgugagcaccaagcggagccagcaggccgugauccccaacaucggcucccgcccccggauccgcggcauccccagccggaucuccaucuacuggacgaucgucaagccgggggacauccuccugaucaacagcaccggcaaccugaucgcgccccgcggguacuucaagauccgguccggcaagagcuccaucaugcgcagcgacgcccccaucggcaagugcaaguccgagugcaucacccccaacgggagcaucccgaacgacaagcccuuccagaacgugaaccggaucaccuacggcgccugcccccgcuacgugaagcacuccacgcucaagcuggccaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcucaaccggcugaucggcaagacgaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucgaguccauccggaacggcaccuacgaccacaacguguaccgcgacgaggcccugaacaaccgguuccagaucaagggggucgagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 74956 - RNA, 1701 nt, Artificial Sequence; identical to SEQ ID NO: 71002
  derived and/or modified sequence opt1 from hemagglutinin__InfluenzaA__EPI404927

SEQ ID NO: 74957 - RNA, 1701 nt, Artificial Sequence
  derived and/or modified sequence opt1 from hemagglutinin__InfluenzaA__EPI489319
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcaagcgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuucccguacgcccagagcuccggccggaucaccgugagcaccaagcgcagccagcaggccgugauccccaacaucggcucccggccccgcauccggaacauccccagccgcaucuccaucuacuggaccaucgucaagccgggggacauccugcugaucaacagcacgggcaaccucaucgcgccccggggguacuucaagauccgcuccggcaagagcuccaucaugcggagcgacgcccccaucggcaagugcaaguccgagugcaucacccccaacgggagcaucccgaacgacaagcccuuccagaacgugaaccgcaucaccuacggcgccugcccccgguacgugaagcaguccacccugaagcuggccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacgucgaggacacgaagaucgaccugugguccuacaacgccgagcugcucguggcccuggagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 74958 - RNA, 1701 nt, Artificial Sequence; identical to SEQ ID NO: 73435
  derived and/or modified sequence opt1 from hemagglutinin__InfluenzaA__EPI530647

SEQ ID NO: 74959 - RNA, 1701 nt, Artificial Sequence; identical to SEQ ID NO: 73449
  derived and/or modified sequence opt1 from hemagglutinin__InfluenzaA__EPI541083

SEQ ID NO: 74960 - RNA, 1701 nt, Artificial Sequence
  derived and/or modified sequence opt1 from hemagglutinin__InfluenzaA__EPI684315
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacauccccucccggaucagcaucuacuggaccaucgucaagccgggcgacauccuccugaucaacuccacggggaaccugaucgcgccccgcggcuacuucaagauccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccucaagcuggccacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 74961 - RNA, 1701 nt, Artificial Sequence
  derived and/or modified sequence opt1 from hemagglutinin__InfluenzaA__EPI614462
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagagcagcggccggaucaccguguccacccgccggagccagcaggccgugaucccgaacaucggcucccgcccccggauccgcgacauccccagccggaucuccaucuacuggaccaucgucaagcccggggacauccugcucaucaacagcacgggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgccugcccccgcuacgugaagcaguccacccugaagcucgcgacggggaugcggaacguccccgagcgccagacccggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcucaagagcggcuacaaggacuggauccuguggaucagcuucgccaucuccugcuuccugcugugcguggcccugcucggguucaucaugugggccugccagaagggcaacauccggugcaacaucugcaucuga

SEQ ID NO: 74962 - RNA, 1701 nt, Artificial Sequence
  derived and/or modified sequence opt1 from hemagglutinin__InfluenzaA__EPI541465
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacaacagcuucuucucccgccugaacuggcucacccaccugaacagcaaguaccccgcccugaacgugaccaugcccaacaacgagcaguucgacaagcucuacaucuggggcguccaccaccccgggacggacaaggaccagaucuuccuguacgcgcaguccagcggccggaucaccgugagcacccgccggucccagcaggccgugaucccgaacaucggcagccgcccccggauccgcgggauccccucccggaucagcaucuacuggaccaucgucaagcccggcgacauccugcucaucaacuccacggggaaccugaucgccccgcgcggcuacuucaagauccggagcggcaaguccagcaucaugcgcuccgacgcccccaucgggaagugcaagagcgagugcaucacccccaacggcuccauccccaacgacaagccguuccagaacgugaaccggaucaccuacggggccugcccccgcuacgugaagcagagcacccugaagcucgcgacgggcaugcggaacguccccgagcgccagacccgggggaucuucggcgccaucgccggcuucaucgagaacgggugggagggcaugguggacgggugguacggcuuccgccaccagaacuccgaggggcggggccaggccgccgaccucaagagcacccaggcggccaucgaccagaucaacggcaagcugaaccgccugaucgggaagaccaacgagaaguuccaccagaucgagaaggaguucuccgagguggagggccgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaagggcgucgagcugaaguccggguacaaggacuggauccuguggaucagcuucgccaucagcugcuuccuccugugcguggcccugcucggcuucaucaugugggccugccagaaggggaacauccggugcaacaucugcaucuga

SEQ ID NO: 74963 - RNA, 1701 nt, Artificial Sequence
  derived and/or modified sequence opt1 from hemagglutinin__InfluenzaA__EPI696967
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccggcugaacuccaaguaccccgcccugaacgugaccaugcccaacaacgagcaguucgacaagcucuacaucuggggcguccaccaccccgagacggacaaggaccagaucuuccuguacgcgcagagcagcgggcgcaucaccguguccacccggcgcagccagcaggccgugaucccgaacaucggcucccggccccgcauccggggcauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagcggcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcgucgagcucaagagcggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 74964 - RNA, 1701 nt, Artificial Sequence
  derived and/or modified sequence opt1 from hemagglutinin__InfluenzaA__EPI674597
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacaacagcuucuucucccgccugaacuggcucacccaccugaacagcaaguaccccgcccugaacgugaccaugcccaacaacgagcaguucgacaagcucuacaucuggggcguccaccaccccgugacggacaaggaccagaucuuccuguacgcgcaguccagcgggcggaucaccgugagcacccgccggucccagcaggccgucaucccgaacaucggcagccgcccccggauccgcggcauccccucccggaucagcaucuacuggaccaucgugaagcccggggacauccugcucaucaacuccacgggcaaccugaucgccccgcgcggguacuucaagauccggagcggcaaguccagcaucaugcgcuccgacgcccccaucggcaagugcaagagcgagugcaucacccccaacggguccauccccaacgacaagccguuccagaacgugaaccggaucaccuacggcgccugcccccgcuacgucaagcagagcacccugaagcucgcgacggggaugcggaacgugcccgagcgccagacccggggcaucuucggggccaucgccggcuucaucgagaacggcugggaggggaugguggacggcugguacggguuccgccaccagaacuccgagggccgggggcaggccgccgaccucaagagcacccaggcggccaucgaccagaucaacggcaagcugaaccgccugaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 74965 - RNA, 1701 nt, Artificial Sequence
  derived and/or modified sequence opt1 from hemagglutinin__InfluenzaA__EPI530677
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagagcagcggccggaucaccguguccaccaagcgcagccagcaggccgugaucccgaacaucggcucccggccccgcauccgggacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagaagcagacccggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcucaagagcggcuacaaggacuggauccuguggaucagcuucgccaucuccugcuuccugcugugcguggcccugcucggguucaucaugugggccugccagaagggcaacauccggugcaacaucugcaucuga

SEQ ID NO: 74966 - RNA, 1701 nt, Artificial Sequence
  derived and/or modified sequence opt1 from hemagglutinin__InfluenzaA__EPI530679
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugcauccggggguccaacagcuccuucuucagccgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcaguccagcggccggaucaccgugagcaccaagcgcucccagcaggccgugaucccgaacaucggcagccggccccgcauccgggacauccccucccgcaucagcaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgccugcccccgguacgugaagcagagcacccugaagcucgcgacggggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacccaggcggccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 74967 - RNA, 1701 nt, Artificial Sequence; identical to SEQ ID NO: 61030
  derived and/or modified sequence opt1 from hemagglutinin__InfluenzaA__AAG01785

SEQ ID NO: 74968 - RNA, 1701 nt, Artificial Sequence; identical to SEQ ID NO: 73435
  derived and/or modified sequence opt1 from hemagglutinin__InfluenzaA__EPI814528

SEQ ID NO: 74969 - RNA, 1701 nt, Artificial Sequence
  derived and/or modified sequence opt1 from hemagglutinin__InfluenzaA__EPI674736
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugccggcgcggguccaacagcuccuucuucagccggcugaacuggcucacccaccugaacuccaaguaccccgcccugaacgugaccaugcccaacaacgagcaguucgacaagcucuacaucuggggcguccaccaccccgugacggacaaggaccagaucuuccuguacgcgcagagcagcgggcgcaucaccguguccaccaagcggagccagcaggccgucaucccgaacaucggcucccgcccccggauccgcgacauccccagccggaucuccaucuacuggaccaucgugaagcccggcgacauccugcucaucaacagcacggggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgucaagcaguccacccugaagcucgcgacgggcaugcggaacgugcccgagcgccagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaaggggguggagcucaagagcggcuacaaggacuggauccuguggaucagcuucgccaucuccugcuuccugcugugcguggcccugcucggcuucaucaugugggccugccagaaggggaacauccggugcaacaucugcaucuga

SEQ ID NO: 74970 - RNA, 1701 nt, Artificial Sequence; identical to SEQ ID NO: 73435
  derived and/or modified sequence opt1 from hemagglutinin__InfluenzaA__EPI614444

SEQ ID NO: 74971 - RNA, 1701 nt, Artificial Sequence
  derived and/or modified sequence opt1 from hemagglutinin__InfluenzaA__EPI551814
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugccggcgcggguccaacagcuccuucuucagccggcugaacuggcucacccgccugaacuccaaguaccccgcccugaacgugaccaugcccaacaacgagcaguucgacaagcucuacaucuggggcguccaccaccccgugacggacaaggaccagaucuuccuguacgcgcagagcagcgggcggaucaccguguccaccaagcgcagccagcaggccgucaucccgaacaucggcucccggccccgcauccgggacauccccagccgcaucuccaucuacuggaccaucgugaagcccggcgacauccugcucaucaacagcacggggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgucaagcaguccacccugaagcucgcgacgggcaugcgcaacgugcccgagcggcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgguuccagaucaaggggguggagcucaagagcggcuacaaggacuggauccuguggaucagcuucgccaucuccugcuuccugcugugcguggcccugcucggcuucaucaugugggccugccagaaggggaacauccgcugcaacaucugcaucuga

SEQ ID NO: 74972 - RNA, 1701 nt, Artificial Sequence
  derived and/or modified sequence opt1 from hemagglutinin__InfluenzaA__EPI696955
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugccggcgcggguccaacagcuccuucuucagccggcugaacuggcucacccaccugaacuccaaguaccccgcccugaacgugaccaugcccaacaacgagcaguucgacaagcucuacaucuggggcguccaccaccccgugacggacaaggaccagaucuuccuguacgcgcagagcagcgggcgcaucaccguguccaccaagcggagccagcaggccgucaucccgaacaucggcuaccgcccccggauccgcgacauccccucccggaucagcaucuacuggaccaucgugaagcccggcgacauccugcucaucaacuccacggggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgucaagcagagcacccugaagcucgcgacgggcaugcggaacgugcccgagcgccagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcacguacgaccacgacgucuaccgggacgaggcccucaacaaccgcuuccagaucaaggggguggagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 74973 - RNA, 1701 nt, Artificial Sequence
  derived and/or modified sequence opt1 from hemagglutinin__InfluenzaA__EPI740790
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccagcugccggcgcggguccaacagcuccuucuucagccggcugaacuggcucacccaccugaacuccaaguaccccgcccugaacgugaccaugcccaacaacgagcaguucgacaagcucuacaucuggggcguccaccaccccgugacggacaaggaccagaucuuccuguacgcgcagagcagcgggcgcaucaccguguccaccaagcggagccagcaggccgucaucccgaacaucggcuuccgcccccggauccgcgacauccccucccggaucagcaucuacuggaccaucgugaagcccggcgacauccugcucaucaacuccacggggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgucaagcagagcacccugaagcucgcgacgggcaugcggaacgugcccgagcgccagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcacguacgaccacgacgucuaccgggacgaggcccucaacaaccgcuuccagaucaaggggguggagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 74974 - RNA, 1701 nt, Artificial Sequence; identical to SEQ ID NO: 69717
  derived and/or modified sequence opt1 from hemagglutinin__InfluenzaA__EPI377499

SEQ ID NO: 74975 - RNA, 1701 nt, Artificial Sequence
  derived and/or modified sequence opt1 from hemagglutinin__InfluenzaA__EPI391247
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggaacggggugacgcagaacggcaccagcuccgccugcauccggcgcagcaacaacuccuucuucagccggcugaacuggcucacccaccugaacuucaaguaccccgcccugaacgugaccaugcccaacaacgagcaguucgacaagcucuacaucuggggcguccaccaccccgugacggacaaggaccagaucuuccuguacgcgcagccguccgggcgcaucaccgugagcaccaagcggucccagcaggccgucauccccaacaucggguuccgcccccggauccgcaacauccccagccggaucagcaucuacuggaccaucgugaagccgggcgacauccugcucaucaacuccacgggcaaccugaucgcgccccgcggguacuucaagauccggagcggcaaguccagcaucaugcgcuccgacgcccccaucgggaagugcaagagcgagugcaucacccccaacggcuccaucccgaacgacaagcccuuccagaacgugaaccggaucaccuacggcgccugcccccgcuacgucaagcagagcacccugaagcucgccacggggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccucaagagcacccaggcggccaucgaccagaucaacggcaagcugaaccggcugaucgggaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 74976 - RNA, 1701 nt, Artificial Sequence
  derived and/or modified sequence opt1 from hemagglutinin__InfluenzaA__EPI407123
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggaacggggugacgcagaacggcaccagcuccgccugcauccggcgcagcaacaacuccuucuucagccggcugaacuggcucacccaccugaacuucaaguaccccgcccugaacgugaccaugcccaacaacgagcaguucgacaagcucuacaucuggggcguccaccaccccgugacggacaaggaccagaucuuccuguacgcgcagccguccgggcgcaucaccgugagcaccaagcggucccagcaggccgucauccccaacaucggguuccgcccccggauccgcaacaaccccagccggaucagcaucuacuggaccaucgugaagccgggcgacauccugcucaucaacuccacgggcaaccugaucgcgccccgcggguacuucaagauccggagcggcaaguccagcaucaugcgcuccgacgcccccaucgggaagugcaagagcgagugcaucacccccaacggcuccaucccgaacgacaagcccuuccagaacgugaaccggaucaccuacggcgccugcccccgcuacgucaagcagagcacccugaagcucgccacggggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccucaagagcacccaggcggccaucgaccagaucaacggcaagcugaaccggcugaucggggagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 74977 - RNA, 1701 nt, Artificial Sequence
  derived and/or modified sequence opt1 from hemagglutinin__InfluenzaA__EPI407126
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggaacggggugacgcagaacggcaccagcuccgccugcauccggcgcagcaacaacuccuucuucagccggcugaacuggcucacccaccugaacuucaaguaccccgcccugaacgugaccaugcccaacaacgagcaguucgacaagcucuacaucuggggcguccaccaccccgugacggacaaggaccagaucuuccuguacgcgcagccguccgggcgcaucaccgugagcaccaagcggucccagcaggccgucauccccaacaucggguuccgcccccggauccgcaacaaccccagccggaucagcaucuacuggaccaucgugaagccgggcgacauccugcucaucaacuccacgggcaaccugaucgcgccccgcggguacuucaagauccggagcggcaaguccagcaucaugcgcuccgacgcccccaucgggaagugcaagagcgagugcaucacccccaacggcuccaucccgaacgacaagcccuuccagaacgugaaccggaucaccuacggcgccugcccccgcuacgucaagcagagcacccugaagcucgccacggggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccucaagagcacccaggcggccaucgaccagaucaacggcaagcugaaccggcugaucgggaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 74978 - RNA, 1701 nt, Artificial Sequence; identical to SEQ ID NO: 74863
  derived and/or modified sequence opt1 from hemagglutinin__InfluenzaA__EPI562037

SEQ ID NO: 74979 - RNA, 1701 nt, Artificial Sequence; identical to SEQ ID NO: 73449
  derived and/or modified sequence opt1 from hemagglutinin__InfluenzaA__EPI562034

SEQ ID NO: 74980 - RNA, 1701 nt, Artificial Sequence
  derived and/or modified sequence opt1 from hemagglutinin__InfluenzaA__EPI653140
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcuccugcuaccccuacgacgugccggacuacgcgagccugcgcucccuggucgccagcuccggcacccucgaguucaacaacgagagcuucaacuggacgggggugacccagaacggcaccuccagcgccugcauccggcgcuccagcuccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcagcgggcgcaucaccguguccaccaagcggagccagcaggccgugauccccaacaucggcucccgcccccggauccgcggcauccccagccggaucuccaucuacuggacgaucgucaagccgggggacauccuccugaucaacagcaccggcaaccugaucgcgccccgcggguacuucaagauccgguccggcaagagcuccaucaugcgcagcgacgcccccaucggcaagugcaaguccgagugcaucacccccaacgggagcaucccgaacgacaagcccuuccagaacgugaaccggaucaccuacggcgccugcccccgcuacgugaagcacuccacgcucaagcuggccaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcucaaccggcugaucggcaagacgaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucagcuucgccaucuccugcuuccugcugugcguggcccuccugggguucaucaugugggccugccagaagggcaacauccgcugcaacaucugcaucuga

SEQ ID NO: 74981 - RNA, 1707 nt, Artificial Sequence
  derived and/or modified sequence opt1 from hemagglutinin__InfluenzaA__ACR48873/m
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucgagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcaccuacgacuacccccaguacuccgaggaggcccgccucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcaucuga

SEQ ID NO: 74982 - RNA, 1707 nt, Artificial Sequence
  derived and/or modified sequence opt1 from hemagglutinin__InfluenzaA__ACR48874/m
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaaggacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcaccuacgacuacccccaguacuccgaggaggcccgccucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcaucuga

SEQ ID NO: 74983 - RNA, 1701 nt, Artificial Sequence; identical to SEQ ID NO: 70154
  derived and/or modified sequence opt1 from hemagglutinin__InfluenzaA__ACD47234

SEQ ID NO: 74984 - RNA, 1707 nt, Artificial Sequence
  derived and/or modified sequence opt1 from hemagglutinin__InfluenzaA__ACZ36881
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccagaacccgaccaccuacaucagcgugggcacguccacccugaaccagcgccucgugcccaagaucgccacccggagcaaggucaacgggcaguccggccgcauggaguucuucuggaccauccugaagcccaacgacgcgaucaacuucgagagcaacgggaacuucaucgcccccgagaacgccuacaagaucgugaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcaaccggcuggugcuggccacggggcuccgcaacuccccgcagggcgagcggcgccggcgcaagcggggccuguucggggcgaucgccggcuucaucgagggcggguggcaggggaugguggacggcugguacggcuaccaccacagcaacgagcagggguccggcuacgccgccgacaaggagagcacccagaaggccaucgacggggugaccaacaaggucaacuccaucaucgacaagaugaacacccaguucgaggcggugggccgcgaguucaacaaccuggagcggcgcaucgagaaccucaacaagaagauggaggacggguuccuggacguguggacguacaacgccgagcugcucguccugauggagaacgagcggacccuggacuuccacgacagcaacgugaagaaccucuacgacaagguccgccugcagcugcgggacaacgccaaggagcucggcaacggcugcuucgaguucuaccaccgcugcgacaacgagugcauggaguccgugcgcaacgggaccuacgacuacccccaguacagcgaggaggcccggcugaagcgcgaggagaucuccggcgugaagcuggagagcaucgggaccuaccagauccucuccaucuacagcacggucgccuccagccuggcgcuggccaucaugguggccggccucucccuguggaugugcagcaacgggagccugcagugccggaucugcaucuga

SEQ ID NO: 74985 - RNA, 1704 nt, Artificial Sequence
  derived and/or modified sequence opt1 from hemagglutinin__InfluenzaA__EPI500771
auggagaagaucgugcuccuguucgccaccaucagccuggucaaguccgaccacaucugcaucggcuaccacgccaacaacagcaccgagcaggucgacacgaucauggagaagaacgugaccgugacccacgcgcaggacauccuggagaagacccacaacgggaagcucugcgaccugaacggcgugaagccccugauccucaaggacugcuccguggccggguggcugcugggcaacccgcucugcgacgaguucacgaacguccccgaguggagcuacaucguggagaaggccaaccccgccaacgaccugugcuaccccgggaacuucaacgacuacgaggagcugaagcaccuccugucccgcaucaaccacuucgagaagauccagaucaucccgaaggacagcugguccgaccacgaggccagccugggcguguccgcggccugcagcuaccagggcaacuccagcuucuuccggaacgucguguggcucaucaagaaggacaacgccuaccccaccaucaagaagggguacaacaacaccaaccgcgaggaccugcugauccucuggggcauccaccaccccaacgacgaggccgagcagaccaagcuguaccagaaccccacgaccuacaucuccaucgggaccagcacccugaaccagcggcucgugccgaagaucgcgacgcgcuccaagaucaaccggcagagcggccgcaucgacuucuucuggaccauccugaagcccaacgacgccauccacuucgaguccaacgggaacuucaucgcccccgaguacgccuacaagaucgucaagaagggcgacagcaccaucaugcgguccgagguggaguacggcaacugcaacacccgcugccagacgcccaucggggccaucaacagcagcaugccguuccacaacauccacccccugaccaucggcgagugccccaaguacgugaaguccaacaagcucguccuggcgaccgggcugcggaacagcccccagcgcgagcggcgccggaagcgcggccucuucggcgccaucgccggguucaucgagggcggguggcagggcaugguggacgggugguacggcuaccaccacuccaacgagcagggcagcggguacgccgccgacaaggaguccacccagaaggcgaucgacggcgugacgaacaaggucaacagcaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacuccaacgugaagaaccuguacgacaaggugcggcuccagcugaaggacaacgccaaggagcuggggaacggcugcuucgaguucuaccacaagugcaacaacgagugcauggagagcguccgcaacggcacguacgacuacccgcaguacuccgaggaggcccggcucaagcgcgaggagaucagcggggugaagcuggaguccaucggcaucuaccagauccugagcaucuacuccaccgucgcgagcucccucgugcuggccaucaugauggccgggcugagccucuggaugugcuccaacggcagccugcagugccgcaucugcaucuga

SEQ ID NO: 74986 - RNA, 1695 nt, Artificial Sequence
  derived and/or modified sequence opt1 from hemagglutinin__InfluenzaA__ABF93441
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaagaacaacgcguaccccaccaucaagcgcuccuacaacaacacgaaccaggaggaccugcugguccucugggggauccaccaccccaacgacgccgccgagcagacccggcuguaccagaacccgaccaccuacaucagcgugggcacguccacccugaaccagcgccucgugcccaagaucgccacccggagcaaggucaacgggcaguccggccgcauggaguucuucuggaccauccugaagcccaacgacgcgaucaacuucgagagcaacgggaacuucaucgcccccgagaacgccuacaagaucgugaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcaaccggcuggugcuggccacggggcuccgcaacuccccgcagaucgagacccggggccuguucggcgcgaucgccggguucaucgagggcggguggcagggcaugguggacgggugguacggcuaccaccacagcaacgagcagggcuccggguacgccgccgacaaggagagcacccagaaggccaucgacggcgugaccaacaaggucaacuccaucaucgacaagaugaacacgcaguucgaggcgguggggcgcgaguucaacaaccuggagcggcgcaucgagaaccucaacaagaagauggaggacggcuuccuggacguguggaccuacaacgccgagcugcucguccugauggagaacgagcggacccuggacuuccacgacagcaacgugaagaaccucuacgacaagguccgccugcagcugcgggacaacgccaaggagcucgggaacggcugcuucgaguucuaccaccgcugcgacaacgagugcauggaguccgugcggaacggcaccuacgacuacccccaguacagcgaggaggcccgccugaagcgggaggagaucuccggggugaagcuggagagcaucggcacguaccagauccucuccaucuacagcaccgucgccuccagccuggcgcuggccaucaugguggccgggcucucccuguggaugugcagcaacggcagccugcagugccgcaucugcaucuga

SEQ ID NO: 74987 - RNA, 1707 nt, Artificial Sequence
  derived and/or modified sequence opt1 from hemagglutinin__InfluenzaA__AGG12577
auggagaagaucgugcugcuguucgccaucaucagccuggucaaguccgaccacaucugcaucggcuaccacgccaacaacagcaccgagcaggucgacaccaucauggagaagaacgugacggugacccacgcgcaggacauccuggagaagacccacaacgggaagcucugcgaccugaacggcgugaagccccugauccucaaggacugcuccguggccggguggcugcugggcaacccgaugugcgacgaguucaucgacguccccgaguggagcuacaucguggagaaggccaaccccgccaacgaccucugcuaccccgggaacuucaacgacuacgaggagcugaagcaccuccucucccgcaucaaccacuucgagaagauccggaucaucccgaaggacagcuggcccgaccacgaggccucccugggcgugagcgcggccugcuccuaccagggcaacagcuccuucuuccgcaacgucguguggcugcucaagaaggacaacgccuaccccaucaucaagaaguccuacaacaacaccaacaaggaggaccugcuggugcucugggggauccaccaccccaacgacgaggccgagcagacgcggcuguaccagaacccgaccaccuacgucagcaucggcaccagcacgcugaaccagcgccucgugccccggaucgcgacccgcuccaaggugaacgggcagagcggccggaucgacuucuucuggaccauccugaagcccaacgacgccaucaacuucgaguccaacgggaacuucaucgcccccgaguacgccuacaagaucgucaagaagggcgacagcaccaucaugcgcuccgagguggaguacggcaacugcagcacgcggugccagaccccgaugggggccaucaacagcuccaugcccuuccacaacauccacccccugaccaucggcgagugccccaaguacgucaagagcaacaagcucgugcuggcgaccgggcugcgcaacuccccgcagaucgagcggcgccggcgcaagcggggccucuucggcgccaucgccggguucaucgagggcggguggcagggcaugguggacgggugguacggcuaccaccacagcaacgagcagggcuccggguacgccgccgacaaggagagcacgcagaaggcgaucgacggcgugaccaacaaggucaacuccaucaucgacaagaugaacacccaguucgaggccguggggcgcgaguucaacaaccuggagcggcgcaucgagaaccugaacaagaagauggaggacggcuuccucgacguguggaccuacaacgccgagcugcugguccucauggagaacgagcggacgcuggacuuccacgacagcaacgugaagaaccuguacgacaagguccgccuccagcugcgggacaacgccaaggagcuggggaacggcugcuucgaguucuaccacaagugcgacaacgagugcauggaguccgugcgcaacggcaccuacgacuacccccaguacagcgaggaggcccgccucaagcgggaggagaucuccggggugaagcuggagagcaucggcaccuaccagauccuguccaucuacagcaccgucgcguccagccucgugcuggccaucaugguggccgggcugucccucuggaugugcagcaacggcucccugcagugccgcaucugcaucuga

SEQ ID NO: 74988 - RNA, 1707 nt, Artificial Sequence; identical to SEQ ID NO: 74987
  derived and/or modified sequence opt1 from hemagglutinin__InfluenzaA__AGC13463

SEQ ID NO: 74989 - RNA, 1707 nt, Artificial Sequence; identical to SEQ ID NO: 66851
  derived and/or modified sequence opt1 from hemagglutinin__InfluenzaA__ACI06178/m1

SEQ ID NO: 74990 - RNA, 1707 nt, Artificial Sequence
  derived and/or modified sequence opt1 from hemagglutinin__InfluenzaA__AHF20402
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugcgcccccugauccuccgggacugcuccgucgccggguggcugcugggcaacccgaugugcgacgaguucaucaacgugcccgaguggagcuacaucguggagaaggccaaccccgucaacgaccucugcuaccccgggguguucaacgacuacgaggagcugaagcaccuccucucccgcaucaaccacuucgagaagauccagaucaucccgaagaacagcuggcccucccacgaggccagccugggcguguccgccgcgugccccuaccagggccagagcuccuucuuccggaacgucguguggcugaucaagaagaacaacaccuaccccacgaucaagcgcagcuacaacaacaccaaccaggaggaccuccuggugaugugggggauccaccacccgaacgacgccgucgagcagaccaagcuguaccagaaccccaccacguacaucuccgugggcaccagcacccucaaccagcggcugacgccccgcaucgccacccgguccaaggugaaggggcugagcggccgcauggaguucuucuggaccauccucaagcccaacgacgccaucaacuucgaguccaacgggaacuucaucgcgccggaguacgccuacaagaucgucaagaagggcgacagcaccaucaugcgguccgagcuggaguacggcaacugcaacaccaagugccagacgcccaugggggccaucaacagcagcaugcccuuccacaacauccacccccugaccaucggcgagugcccgaaguacgugaaguccacccgccucgugcuggccaccgggcugcggaacagcccccagcgcgaggagcggcgcaagaagcggggccucuucggcgccaucgcgggguucaucgagggcggguggcagggcauggucgacgggugguacggcuaccaccacuccaacgagcagggcagcggguacgccgccgacaaggaguccacgcagaaggccaucgacggcgugaccaacaaggugaacagcaucaucgacaagaugaacacccaguucgaggccgucgggcgcgaguucaacaaccuggagcggcgcaucgagaaccugaacaagaagauggaggacggcuuccucgacguguggaccuacaacgcggagcugcugguccucauggagaacgagcggacgcuggacuuccacgacuccaacgugaagaaccuguacgacaaggugcgccuccagcugcgggacaacgccaaggagcuggggaacggcugcuucgaguucuaccacaagugcgacaacaagugcauggagagcguccgcaacggcaccuacgacuacccccaguacuccgaggaggcccgccucaagcgggaggagaucagcggggugaagcuggaguccaucggcguguaccagauccugagcaucuacuccaccgucgccagcucccucgcccuggcgaucaugguggccgggcugagccucuggaugugcuccaacggcagccugcagugccgcaucugcaucuga

SEQ ID NO: 74991 - RNA, 1707 nt, Artificial Sequence
  derived and/or modified sequence opt1 from hemagglutinin__InfluenzaA__ABQ45850
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaagaacgacgcguaccccaccaucaagcgcuccuacaacaacacgaaccaggaggaccugcugguccucugggggauccaccaccccaacgacgccgccgagcagacccggcuguaccagaacccgaccaccuacaucagcgugggcacguccacccugaaccagcgccucgugcccaagaucgccacccggagcaaggucaacgggcaguccggccgcauggaguucuucuggaccauccugaagcccaacgacgcgaucaacuucgagagcaacgggaacuucaucgcccccgagaacgccuacaagaucgugaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcaaccggcuggugcuggccacggggcuccgcaacuccccgcagggcgagcggcgccggaagaagcgcggccuguucggggcgaucgccggcuucaucgagggcggguggcaggggaugguggacggcugguacggcuaccaccacagcaacgagcagggguccggcuacgccgccgacaaggagagcacccagaaggccaucgacggggugaccaacaaggucaacuccaucaucgacaagaugaacacccaguucgaggcggugggccgggaguucaacaaccuggagcgccggaucgagaaccucaacaagaagauggaggacggguuccuggacguguggacguacaacgccgagcugcucguccugauggagaacgagcgcacccuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacagcgaggaggcccgccugaagcgggaggagaucuccggcgugaagcuggagagcaucgggaccuaccagauccucuccaucuacagcacggucgccuccagccuggcgcuggccaucaugguggccggccucucccuguggaugugcagcaacgggagccugcagugccgcaucugcaucuga

SEQ ID NO: 74992 - RNA, 1713 nt, Artificial Sequence
  derived and/or modified sequence opt1 from hemagglutinin__InfluenzaA__AKI82373
auggagaagaucgugccccugcucgccaucaucggccuggucaagagcgaccagaucugcaucggguaccacgccaacaacuccaccgagcaggucgacaccaucauggagaagaacgugacggugacccacgcgcaggacauccuggagaagacccacaacggcaagcucugcaaccuggacggggugaagccgcugauccucaaggacugcagcguggccggcuggcugcuggggaaccccaugugcgacgaguuccucaacgucuccgaguggagcuacaucguggagaaggccucccccgccaacggccugugcuaccccggcgacuucaacgacuacgaggagcugaagcaccuccugaaccgcaucacccaccugaagaagaucaagaucauccccaagagcuacugguccaaccacgaggccagcuccggggugagcgcggccugcuccuacaugggcgagcccagcuucuuccggaacgucguguggcucaucaagaagaacaacacguacccgcccaucaaggugaacuacaccaacaccaaccaggaggaccugcugguccucugggggauccaccacccgaacaacgaggccgagcagauccagaucuaccagaaccugaucacccacaucuccgugggcacgagcacccugaaccagcgccucauccccaagaucgccacccgguccaaggugaacgggcagagcggccgcauggaguucuucuggaccauccugaagcccaacgacuccaucaacuucgacagcaacggcaacuucaucgcgcccgaguacgccuacaucgucaagaagggggacuccgccaucaugaaguccgagcuggaguacggcaacugcaacacgaagugccagaccccgaugggggccaucaacagcagcaugcccuuccacaacauccacccccucaccaucggcgagugccccaaguacgucaagagcaaccggcuggugcuggccaccggccuccgcaacgcgccgcagcgggagcgcgagggcgggcggcgccggaagcgcgggcuguucggcgccaucgccggguucaucgagggcggcuggcaggggaugguggacggcugguacggguaccaccacuccaacgagcagggcagcggguacgccgccgacaaggaguccacgcagaaggcgaucgacggcaucaccaacaaggugaacagcaucaucgacaagaugaacacccaguucgaggccgugggccgggaguucaacaaccuggagcgccggaucgagaaccucaacaagaagauggaggacggguuccuggacgucuggaccuacaacgccgagcugcucgugcugauggagaacgagcgcacgcuggacuuccacgacuccaacgugaagaaccucuacgagaagguccggcugcagcugcgcgacaacgccaaggagcucggcaacgggugcuucgaguucuaccacaagugcgacaacgagugcauggagagcgugcggaacggcaccuacgacuacucccaguacagcgaggaggcccgccugucccgggaggagaucaacggggucaagcuggagagcauggugaccuaccagauccucuccaucuacagcaccguggcguccagccuggcccuggccaucauggucgccggccucucccuguggaugugcagcaacggcucccugcagugccgcaucugcaucuga

SEQ ID NO: 74993 - RNA, 1713 nt, Artificial Sequence
  derived and/or modified sequence opt1 from hemagglutinin__InfluenzaA__EPI284473
auggagaagaucgugcugcuccuggccaucaucagccuggucaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugaaggacugcuccguggccggguggcugcucggcaacccgaugugcgacgaguuccugaacgucagcgagugguccuacaucguggagaaggccagccccgccaacgggcugugcuaccccggcgacuucaacgacuacgaggagcucaagcaccuccugaaccgcaucacccaccugaagaagaucaagaucauccccaaguccuacuggagcaaccacgaggccuccagcggcguguccgcggccugcagcuacaugggggagccguccuucuuccggaacgucguguggcugaucaagaagaacaacacguacccgcccaucaaggugaacuacaccaacaccaaccaggaggaccugcucguccuguggggcauccaccaccccaacaacgaggccgagcagauccagaucuaccagaaccugaucacccacaucagcguggggacguccacccucaaccagcgccugauccccaagaucgccacccggagcaaggugaacggccaguccgggcgcauggaguucuucuggaccauccugaagcccaacgacagcaucaacuucgacuccaacggcaacuucaucgcgcccgaguacgccuacaucgucaagaagggcgacagcgccaucaugaaguccgagcucgaguacgggaacugcaacacgaagugccagacccccaugggcgccaucaacagcagcaugccguuccacaacauccacccccugaccaucggggagugccccaaguacgugaaguccaaccggcuggugcucgccaccggccugcgcaacgcgccccagcgggagcgcgagggcgggcggcgccggaagcgcggccuguucggggccaucgccggcuucaucgagggcggguggcagggcauggucgacgggugguacggcuaccaccacagcaacgagcagggguccggcuacgccgccgacaaggagagcacgcagaaggcgaucgacgggaucaccaacaaggugaacuccaucaucgacaagaugaacacccaguucgaggccgugggccgggaguucaacaaccucgagcgccggaucgagaaccugaacaagaagauggaggacggcuuccuggacgucuggaccuacaacgccgagcuccuggugcugauggagaacgagcgcacgcucgacuuccacgacagcaacgugaagaaccuguacgagaagguccggcugcagcuccgcgacaacgccaaggagcuggggaacggcugcuucgaguucuaccacaagugcgacaacgagugcauggaguccgugcggaacgggaccuacgacuacagccaguacuccgaggaggcccgccugagccgggaggagaucaacggcgucaagcucgaguccauggugaccuaccagauccugagcaucuacuccaccguggcgagcucccuggcccucgccaucauggucgccgggcugagccuguggaugugcuccaacggcagccuccagugccgcaucugcaucuga

SEQ ID NO: 74994 - RNA, 1710 nt, Artificial Sequence
  derived and/or modified sequence opt1 from hemagglutinin__InfluenzaA__ACO07033
auggagaagaucgugcugcuccuggccaugaucggccuggucaagagcgaccagaucugcaucggguaccacgccaacaacuccaccgagcaggucgacaccaucauggagaagaacgugacggugacccacgcgcaggacauccucgagaagacccacaacggcaagcugugcaaccuggacggggugaagccccucauccugaaggacugcagcguggccggcuggcugcucgggaacccgaugugcgacgaguuccugaacgucuccgaguggagcuacaucguggagaaggccucccccgccaacggccugugcuaccccggcgacuucaacgacuacgaggagcucaagcaccuccugagccgcaucaaccaccugaagaagaucaagaucauccccaaguccuacuggagcaaccacgaggccuccagcgggguguccgcggccugcagcuaccugggcgagccguccuucuuccggaacgucguguggcugaucaagaagaacaacaccuacccgcccaucaaggugaacuacacgaacaccaaccaggaggaccuccugguccugugggggauccaccaccccaacgacgagaaggagcagauccgcaucuaccagaaccccaacaccagcaucuccgugggcaccagcacgcucaaccagcggcuggugcccaagaucgccacccgccccaaggucaacgggcaguccggccggauggaguucuucuggaccauccugaagcccaacgacagcaucaacuucgacuccaacggcaacuucaucgccccggaguacgcguacaagaucgccaagaagggggacagcgugaucaugaaguccgagcucgaguacggcaacugcaacaccaagugccagacgcccaugggggccaucaacagcagcaugcccuuccacaacauccacccccugaccaucggcgagugcccgaaguacgugaaguccaaccgccugguccucgccaccggccugcggaacgcgccccagcgcgagggcgggcggcgccggaagcgcgggcuguucggcgccaucgccggguucaucgagggcggcuggcaggggaugguggacggcugguacggguaccaccacagcaacgagcagggcuccggguacgccgccgacaaggagagcacccagaaggccaucgacggcaucacgaacaaggugaacuccaucaucgacaagaugaacacccaguucgagaucgucggccgggaguucaacaaccucgagcgccggaucgagaaccugaacaagaagauggaggacggguuccuggacguguggaccuacaacgcggagcuccuggugcugauggagaacgagcgcacccucgacuuccacgacagcaacgucaagaaccuguacgagaaggugcggcugcagcuccgcgacaacgccaaggagcugggcaacgggugcuucgaguucuaccacaagugcgacaacgagugcauggaguccguccggaacggcacguacgacuacccccaguacagcgaggaggcccgccugucccgggaggagaucagcggggugaagauggaguccauggugaccuaccagauccucagcaucuacuccaccgucgccagcucccuggcccuggcgaucaugguggccggccucagccuguggaugugcuccaacggcagccugcagugccgcaucugcaucuga

SEQ ID NO: 74995 - RNA, 1695 nt, Artificial Sequence
  derived and/or modified sequence opt1 from hemagglutinin__InfluenzaA__EPI174803
auggagaagaucgugcugcuccuggccaugaucggccuggucaagagcgaccagaucugcaucggguaccacgccaacaacuccaccgagcaggucgacaccaucauggagaagaacgugacggugacccacgcgcaggacauccucgagaagacccacaacggcaagcugugcaaccuggacggggugaagccccucauccugaaggacugcagcguggccggcuggcugcucgggaacccgaugugcgacgaguuccugaacgucuccgaguggagcuacaucguggagaaggccucccccgccaacggccugugcuaccccggcgacuucaacgacuacgaggagcucaagcaccuccugagccgcaucaaccaccugaagaagaucaagaucauccccaaguccuacuggagcaaccacgaggccuccagcgggguguccgcggccugcagcuaccugggcgagccguccuucuuccggaacgucguguggcugaucaagaagaacaacaccuacccgcccaucaaggugaacuacacgaacaccaaccaggaggaccuccugguccugugggggauccaccaccccaacgacgagaaggagcagauccgcaucuaccagaaccccaacaccagcaucuccgugggcaccagcacgcucaaccagcggcuggugcccaagaucgccacccgccccaaggucaacgggcaguccggccggauggaguucuucuggaccauccugaagcccaacgacagcaucaacuucgacuccaacggcaacuucaucgccccggaguacgcguacaagaucgccaagaagggggacagcgugaucaugaaguccgagcucgaguacggcaacugcaacaccaagugccagacgcccaugggggccaucaacagcagcaugcccuuccacaacauccacccccugaccaucggcgagugcccgaaguacgugaaguccaaccgccugguccucgccaccggccugcggaacgcgccccagaccgagacgcgcgggcuguucggcgccaucgccggguucaucgagggcggguggcagggcaugguggacggcugguacggguaccaccacagcaacgagcagggcuccggguacgccgccgacaaggagagcacccagaaggccaucgacggcaucaccaacaaggugaacuccaucaucgacaagaugaacacccaguucgagaucgucgggcgggaguucaacaaccucgagcgccggaucgagaaccugaacaagaagauggaggacggcuuccuggacguguggacguacaacgcggagcuccuggugcugauggagaacgagcgcacccucgacuuccacgacagcaacgucaagaaccuguacgagaaggugcggcugcagcuccgcgacaacgccaaggagcugggcaacgggugcuucgaguucuaccacaagugcgacaacgagugcauggaguccguccggaacggcaccuacgacuacccccaguacagcgaggaggcccgccugucccgggaggagaucagcggggugaagauggaguccauggugaccuaccagauccucagcaucuacuccacggucgccagcucccuggcccuggcgaucaugguggccggccucagccuguggaugugcuccaacgggagccugcagugccgcaucugcaucuga

SEQ ID NO: 74996 - RNA, 1704 nt, Artificial Sequence
  derived and/or modified sequence opt1 from hemagglutinin__InfluenzaA__AGZ62382
auggagaagaucgugcugcuguucgccgccaucagccuggucaaguccgaccacaucugcaucggcuaccacgcgaacaacagcaccaagcaggucgacaccaucauggagaagaacgugacggugacccacgcccaggacauccuggagaagacccacaacgggaagcucugcgaccugaacggcgugaagccccugauccucaaggacugcuccguggccggguggcugcugggcaacccgaugugcgacgaguucaucaacguccccgaguggagcuacaucguggagaaggccaaccccgccaacgggcucugcuaccccggcaacuucaacgacuacgaggagcugaagcaccuccucucccgcaucaaccacuucgagaagauccggaucaucccgaaggacagcugguccgaccacgaggcgagccugggcguguccgccgccugccccuaccaggggaacagcuccuucuuccgcaacgucguguggcugaucaagaaggacaacaccuaccccacgaucaagaaguccuacaacaacaccaaccaggaggaccuccugauccuguggggcauccaccaccccaacgacgaggccgagcagacccggcucuaccagaacccgaccacguacaucagcaucgggaccagcacccugaaccagcgccuggugcccaagaucgcgacccgguccaagaucaacggccagagcgggcgcaucgacuucuucuggacgauccucaagcccaacgacgccauccacuucgaguccaacggcaacuucaucgcccccgaguacgccuacaagaucgucaagaagggcgacagcaccaucaugaaguccgagguggaguacgggaacugcaacacccggugccagaccccgaucggcgccaucaacagcagcaugcccuuccacaacauccacccccugacgaucggggagugccccaaguacgugaaguccaacaagcugguccucgcgaccggccugcgcaacagcccgcagcgggagcgccggcgcaagcggggccuguucggggccaucgccggcuucaucgagggcggguggcaggggaugguggacggcugguacggcuaccaccacuccaacgagcaggggagcggcuacgccgccgacaaggaguccacccagaaggcgaucgacggggugaccaacaaggucaacagcaucaucgacaagaugaacacgcaguucgaggccgugggccgcgaguucaacaaccucgagcggcgcaucgagaaccugaacaagaagauggaggacggguuccuggacguguggaccuacaacgccgagcuccugguccugauggagaacgagcggacccucgacuuccacgacuccaacgugcgcaaccuguacgacaaggugcggcugcagcucaaggacaacgccaaggagcugggcaacggcugcuucgaguucuaccacaagugcaacaacgagugcauggagagcguccgcaacgggaccuacgacuacccccaguacuccgaggaggcccggcugcgccgcgaggagaucagcggcgugaagcucgaguccaucgggaucuaccagauccugagcaucuacuccacggucgcgagcucccuggugcucgccaucaugauggccggccugagccuguggaugugcuccaacgggagccuccagugccggaucugcaucuga

SEQ ID NO: 74997 - RNA, 1704 nt, Artificial Sequence
  derived and/or modified sequence opt1 from hemagglutinin__InfluenzaA__ABG67978/m
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggaggaccuccugauccugugggggauccaccacuccaacgacgccgccgagcagaccaagcucuaccagaacccgacgaccuacaucagcgucggcaccuccacccugaaccagcgccuggugcccaagaucgccacgcggagcaaggugaacgggcaguccggccgcauggacuucuucuggaccauccucaagcccaacgacgcgaucaacuucgagagcaacgggaacuucaucgcccccgaguacgccuacaagaucgucaagaagggcgacagcgccaucaucaaguccgagguggaguacggcaacugcaacaccaagugccagaccccgaucggggccaucaacagcuccaugcccuuccacaacauccacccccugacgaucggcgagugccccaaguacgucaagagcaacaagcuggugcucgcgaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggucaacuccaucaucgacaagaugaacacgcaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggugaagcuggagagcaucggcacguaccagauccuguccaucuacagcaccgucgcguccagccucgcccuggccaucaugguggccgggcugucccucuggaugugcagcaacggcagccugcagugccgcaucugcaucuga

SEQ ID NO: 74998 - RNA, 1695 nt, Artificial Sequence
  derived and/or modified sequence opt1 from hemagglutinin__InfluenzaA__EPI827075
auggagaagaucgugcuccuguucgccaccaucagccuggucaaguccgaccacaucugcaucggcuaccacgccaacaacagcaccgagcaggucgacacgaucauggagaagaacgugaccgugacccacgcgcaggacauccuggagaagacccacaacgggaagcucugcgaccugaacggcgugaagccccugauccucaaggacugcuccguggccggguggcugcugggcaacccgcucugcgacgaguucacgaacguccccgaguggagcuacaucguggagaaggccaaccccgccaacgaccugugcuaccccgggaacuucaacgacuacgaggagcugaagcaccuccugucccgcaucaaccacuucgagaagauccagaucaucccgaaggacagcugguccgaccacgaggccagccugggcguguccgcggccugcagcuaccagggcaacuccagcuucuuccggaacgucguguggcucaucaagaaggacaacgccuaccccaccaucaagaagggguacaacaacaccaaccgcgaggaccugcugauccucuggggcauccaccaccccaacgacgaggccgagcagacccggcuguaccagaaccccacgaccuacaucuccaucgggaccagcacccugaaccagcgccucgugccgaagaucgcgacgcgguccaagaucaacggccagagcgggcgcaucgacuucuucuggaccauccugaagcccaacgacgccauccacuucgaguccaacggcaacuucaucgcccccgaguacgccuacaagaucgucaagaagggcgacagcaccaucaugcgguccgagguggaguacgggaacugcaacacccgcugccagacgcccaucggcgccaucaacagcagcaugccguuccacaacauccacccccugaccaucggggagugccccaaguacgugaaguccaacaagcucguccuggcgaccggccugcggaacagcccccagcgcgagacccggggccucuucggggccaucgccggcuucaucgagggcggguggcaggggaugguggacggcugguacggcuaccaccacuccaacgagcaggggagcggcuacgccgccgacaaggaguccacgcagaaggcgaucgacggggugaccaacaaggucaacagcaucaucgacaagaugaacacccaguucgaggccgugggccgcgaguucaacaaccuggagcggcgcaucgagaaccugaacaagaagauggaggacggguuccucgacguguggaccuacaacgccgagcugcugguccucauggagaacgagcggacgcuggacuuccacgacuccaacgugaagaaccuguacgacaaggugcgccuccagcugaaggacaacgccaaggagcugggcaacggcugcuucgaguucuaccacaagugcaacaacgagugcauggagagcguccggaacgggaccuacgacuacccgcaguacuccgaggaggcccgccucaagcgggaggagaucagcggcgugaagcuggaguccaucgggaucuaccagauccugagcaucuacuccaccgucgcgagcucccucgugcuggccaucaugauggccggccugagccucuggaugugcuccaacgggagccugcagugccgcaucugcaucuga

SEQ ID NO: 74999 - RNA, 1707 nt, Artificial Sequence
  derived and/or modified sequence opt1 from hemagglutinin__InfluenzaA__ABP96850
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccggggacuucaacgacuacgaggagcucaagcaccuccugucccggaucaaccacuucgagaagauccagaucauccccaagagcuccuggagcgacuacgaggccuccagcggcgucuccagcgccugcccguaccagggccgcuccagcuucuuccggaacgugguguggcugaucaagaagaacaacgcguaccccaccaucaagcgcuccuacaacaacacgaaccaggaggaccugcugguccucugggggauccaccaccccaacgacgccgccgagcagauccggcuguaccagaacccgaccaccuacaucagcgugggcaccuccacgcugaaccagcgccucgugcccaagaucgccacccggagcaaggucaacgggcaguccggccgcauggaguucuucuggaccauccucaagagcaacgacgcgaucaacuucgagagcaacgggaacuucaucgcccccgaguacgccuacaagaucgugaagaagggcgacuccaccaucaugaaguccgagcuggaguacggcaacugcaacacgaagugccagacccccaucggggccaucaacagcagcaugccguuccacaacauccacccccugaccaucggcgagugccccaaguacgugaaguccaaccggcugguccuggccaccgggcuccgcaacagcccccagggcgagcggcgccggcgcaagcggggccuguucggggcgaucgccggcuucaucgagggcggguggcaggggaugguggacggcugguacggcuaccaccacuccaacgagcaggggagcggcuacgccgccgacaaggaguccacgcagaaggccaucgacggggugaccaacaaggucaacagcaucaucaacaagaugaacacccaguucgaggcggugggccgcgaguucaacaaccuggagcggcgcaucgagaaccucaacaagaagauggaggacggguuccuggacguguggaccuacaacgccgagcugcucguccugauggagaacgagcggacgcuggacuuccacgacuccaacgugaagaaccucuacgacaagguccgccugcagcugcgggacaacgccaaggagcucggcaacggcugcuucgaguucuaccaccgcugcgacaacgagugcauggagagcgugcgcaacgggaccuacgacuacccgcaguacuccgaggaggcccggcugaagcgcgaggagaucagcggcgugaagcuggaguccaucgggaucuaccagauccucagcaucuacuccaccgucgccagcucccuggcgcuggccaucaugguggccggccucuuccuguggaugugcagcaacgggagccugcagugccggaucugcaucuga

SEQ ID NO: 75000 - RNA, 1692 nt, Artificial Sequence
  derived and/or modified sequence opt1 from hemagglutinin__InfluenzaA__EPI827077
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaaggacagcugguccgaccacgaggccagcggcgucuccagcgccugccccuaccagggccgcuccagcuucuuccggaacgugguguggcugaccaagaagaacgacgcguaccccacgaucaagaaguccuacaacaacaccaaccaggaggaccuccugguccugugggggauccaccaccccaacgacgccgccgagcagacccgccucuaccagaacccgaccacguacaucagcgugggcaccuccacccugaaccagcggcuggugcccaagaucgccacccgcagcaaggucaacgggcaguccggccggauggaguucuucuggacgauccucaagagcaacgacgcgaucaacuucgaguccaacgggaacuucaucgcccccgagaacgccuacaagaucgugaagaagggcgacagcaccaucaugaaguccgagcuggaguacuccaacugcaacaccaagugccagacccccaucggcgccaucaacagcuccaugccguuccacaacauccacccccugacgaucggggagugccccaaguacgucaagagcaaccgccucgugcuggccaccggccugcggaacagcccccagcgcgagacccggggccucuucggggcgaucgccggcuucaucgagggcggguggcaggggaugguggacggcugguacggguaccaccacagcaacgagcagggcuccggcuacgccgccgacaaggagagcacccagcgcgccaucgacggggugacgaacaaggucaacuccaucaucgacaagaugaacacccaguucgaggcggugggccgggaguucaacaaccuggagcgccggaucgagaaccugaacaagaagauggaggacggguuccucgacguguggaccuacaacgccgagcugcugguccucauggagaacgagcgcacccuggacuuccacgacagcaacgugaagaaccuguacgacaagguccggcuccagcugcgcgacaacgccaaggagcugggcaacgggugcuucgaguucuaccaccggugcgacaacgagugcauggaguccgugcgcaacggcacguacgacuacccgcaguacagcgaggaggcccggcucaagcgcgaggagaucuccggcgugaagcuggagagcaucgggaccuaccagauccuguccaucuacagcaccgucgccuccagccucgcgcuggccaucaugguggccggccugucccucuggaugugcagcaacgggagccugcagugccgcaucugcaucuga

SEQ ID NO: 75001 - RNA, 1704 nt, Artificial Sequence
  derived and/or modified sequence opt1 from hemagglutinin__InfluenzaA__EPI594523
auggagaagaucauccugcuccuggccaucaucggccuggucaagagcgaccagaucugcgugggguaccacgccaacaacuccaccgagcgcguggacaccaucauggagaagaacgugacggucacccacgcgcaggacauccucgagaagacccacaacggcaagcugugcaaccugaacggggugaagccccucauccuggaggacugcagcguggccggcuggcugcucgggaacccgaugugcgacaaguuccugaacgucuccgaguggagcuacaucguggagaaggccggccccgccaacggccugugcuaccccggggacuucaacgacuacgaggagcucaagcaccuccugucccggaucaaccacuucgagaagaucgagaucauccccaagaaccacuggagcaaccacaacaccuccggcgugagcuccgccugcagcuaccuggagaacccguccuucuuccgcaacgucguguggcugacgaagaagaacaacaccuaccccaccaucaaggugaacuacaccaacgcgaaccagaaggaccugcucguccugugggggauccaccaccccaacaacgaggccgagcagaagaugaucuaccagaacagcaacacguacguguccgugggcaccagcacccugaaccagcggcucguccccaagaucgccacccgcuccaaggugaacgggcagagcggccggaucgacuucuucuggacgauccugaagccgaacgacaccaucaacuucgacuccaacggcaacuucaucgcccccaaguacgcguacaagaucgugaagaagggggacagcgccaucaugaaguccgagcugaaguacgacaacugcaacaccaagugccagacccccaucggcgccaucaacagcagcaugcccuuccacaacauccacccgcucacgaucggggagugccccaaguacgucaaguccaaccgccuggugcuggccaccggccuccggaacgcgccccagaucgagggccgccggcgcaagcgggggcuguucggcgccaucgccggguucaucgagggcggguggcagggcaugguggacggcugguacggguaccaccacagcaacgagcagggcuccggguacgccgccgacaaggagagcacccagaaggccgucgacggcaucaccaacaagaucaacuccaucaucgacaagaugaacaaccaguucgaggcgguggggcgcgaguucaacaaccuggagcggcgcaucgagaaccucaacaagaagauggaggacggcuuccuggacguguggacguacaacgccgagcugcucguccugauggagaacgagcggacccuggacuuccacgacagcaacgugaagaaccucuacgagaagguccgccugcagcugcgggacaacgccaaggagcucggcaacgggugcuucgaguucuaccacaagugcgacaacgagugcauggaguccgugaagaacggcaccuacgacuacccccaguacagcgaggaggcccgccugaaccgggaggagaucuccggggugaagcuggagagcaccgucacguaccagauccucuccaucuacagcaccguggccuccagccuggugcuggcgaucauggucgccggccucucccuguggaugugcagcaacgggucccugcagugccgcaucugcaucuga

SEQ ID NO: 75002 - RNA, 1707 nt, Artificial Sequence
  derived and/or modified sequence opt1 from hemagglutinin__InfluenzaA__AAD37782
auggagcgcaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugcgggacugcuccgucgccggguggcugcucggcaacccgaugugcgacgaguucaucaacgugcccgaguggagcuacaucguggagaaggccucccccgccaacgaccugugcuaccccggggacuucaacgacuacgaggagcugaagcaccuccugagccgcaccaaccacuucgagaagauccagaucaucccgcccuccagcugguccaaccacgacgccagcuccggcgucagcuccgcgugccccuaccacggccggagcuccuucuuccgcaacgugguguggcugaucaagaagaacagcgccuaccccacgaucaagcgguccuacaacaacaccaaccaggaggaccuccugguccugugggggauccaccacccgaacgacgccgccgagcagaccaagcucuaccagaaccccaccacguacaucagcgugggcaccuccacccugaaccagcgccuggugcccgagaucgcgacccggcccaaggucaacgggcagagcggccgcauggaguucuucuggacgauccucaagccgaacgacgccaucaacuucgagagcaacgggaacuucaucgcccccgaguacgccuacaagaucgugaagaagggcgacuccgccaucaugaaguccgagcuggaguacggcaacugcaacaccaagugccagacccccaugggggcgaucaacagcagcaugcccuuccacaacauccacccgcugaccaucggcgagugccccaaguacgugaaguccaaccggcucguccuggccacggggcugcgcaacacgccccagcgggagcgccggcgcaagaagcggggccucuucggcgccaucgccggguucaucgagggcggguggcagggcauggugaacgggugguacggcuaccaccacagcaacgagcagggcuccggguacgccgcggacaaggagagcacccagaaggccaucgacggcgugaccaacaaggucaacuccaucaucgacaagaugaacacccaguucgaggccguggggcgcgaguucaacaaccuggagcggcgcaucgagaaccugaacaagcagauggaggacggcuuccucgacguguggaccuacaacgccgagcugcugguccucauggagaacgagcggacccuggacuuccacgacagcaacgugaagcaccuguacgacaagguccgccuccagcugcgggacaacgccaaggagcuggggaacggcugcuucgaguucuaccacaagugcgacaacgagugcauggaguccgugaagaacggcaccuacgacuacccccaguacagcgaggaggcgcgccucaaccgcgaggagaucuccggggugaagcuggagagcaugggcacguaccagauccuguccaucuacagcaccgucgccuccagccucgcccuggccaucaugguggccgggcugucccucuggaugugcagcaacggcagccugcagugccggaucugcaucuga

SEQ ID NO: 75003 - RNA, 1707 nt, Artificial Sequence
  derived and/or modified sequence opt1 from hemagglutinin__InfluenzaA__AAD51927
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugcgcgacugcuccgucgccggguggcugcucggcaacccgaugugcgacgaguucaucaacgugcccgaguggagcuacaucguggagaaggccucccccgccaacgaccugugcuaccccggggacuucaacgacuacgaggagcugaagcaccuccugagccggaccaaccacuucgagaagauccagaucaucccgaaguccagcugguccaaccacgacgccagcuccggcgucagcuccgcgugccccuaccacggccgcagcuccuucuuccggaacgugguguggcugaucaagaagaacagcgccuaccccacgaucaagcgcuccuacaacaacaccaaccaggaggaccuccugguccugugggggauccaccaccccaacgacgccgccgagcagaccaagcucuaccagaacccgaccacguacaucagcgugggcaccuccacccugaaccagcggcuggugcccgagaucgcgacccgccccaaggucaacgggcagagcggccggauggaguucuucuggacgauccucaagcccaacgacgccaucaacuucgagagcaacgggaacuucaucgccccggaguacgccuacaagaucgugaagaagggcgacuccgccaucaugaaguccgagcuggaguacggcaacugcaacaccaagugccagacccccaugggggcgaucaacagcagcaugcccuuccacaacauccacccccugaccaucggcgagugcccgaaguacgugaaguccaaccgccucguccuggccacggggcugcggaacacgccccagcgcgagcggcgccggaagaagcgcggccucuucggcgccaucgccggguucaucgagggcggguggcagggcaugguggacgggugguacggcuaccaccacagcaacgagcagggcuccggguacgccgcggacaaggagagcacccagaaggccaucgacggcgugaccaacaaggucaacuccaucaucgacaagaugaacacccaguucgaggccguggggcgggaguucaacaaccuggagcgccggaucgagaaccugaacaagcagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugaagaacggcaccuacgacuacccccaguacagcgaggaggcgcggcucaaccgcgaggagaucuccggggugaagcuggagagcaugggcacguaccagauccuguccaucuacagcaccgucgccuccagccucgcccuggccaucaugguggccgggcugucccucuggaugugcagcaacggcagccugcagugccgcaucugcaucuga

SEQ ID NO: 75004 - RNA, 1704 nt, Artificial Sequence; identical to SEQ ID NO: 68725
  derived and/or modified sequence opt1 from hemagglutinin__InfluenzaA__AEO89181

SEQ ID NO: 75005 - RNA, 1707 nt, Artificial Sequence; identical to SEQ ID NO: 70179
  derived and/or modified sequence opt1 from hemagglutinin__InfluenzaA__AFM78567

SEQ ID NO: 75006 - RNA, 1707 nt, Artificial Sequence
  derived and/or modified sequence opt1 from hemagglutinin__InfluenzaA__ACR48872
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccaccaacgaccugugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcucaucaagaagaacagcacguaccccaccaucaagaaguccuacaacaacaccaaccaggaggaccugcugguccucugggggauccaccacccgaacgacgcggccgagcagaccaugcuguaccagaaccccacgaccuacaucagcaucggcaccuccacccugaaccagcggcucgugcccaagaucgccacgcgcagcaaggugaacgggcagagcggccggauggaguucuucuggaccauccugaagcccaacgacgccaucaacuucgaguccaacgggaacuucaucgcgccggaguacgccuacaagaucgucaagaagggcgacagcgccaucaugaaguccgagcuggaguacggcaacugcaacaccaagugccagacccccaugggggccaucaacagcuccaugcccuuccacaacauccacccccucacgaucggcgagugcccgaaguacgugaaguccaaccgccuggugcuggccaccgggcuccggaacagcccccagcgcgagagccggcgcaagaagcggggccuguucggcgcgaucgccggguucaucgagggcggguggcagggcauggucgacgggugguacggcuaccaccacuccaacgagcagggcagcggguacgccgccgacaaggaguccacccagaaggccaucgacggcgugaccaacaaggugaacagcaucaucgacaagaugaacacgcaguucgaggcggucgggcgcgaguucaacaaccuggagcggcgcaucgagaaccucaacaagaagauggaggacggcuuccuggacguguggaccuacaacgccgagcugcucgugcugauggagaacgagcggacccuggacuuccacgacuccaacgucaagaaccucuacgacaaggugcgccugcagcugcgggacaacgccaaggagcucgggaacggcugcuucgaguucuaccacaagugcgacaacgagugcauggagagcauccgcaacggcaccuacaacuacccccaguacuccgaggaggcccggcugaagcgcgaggagaucagcggggucaagcuggaguccaucggcacguaccagauccucagcaucuacuccaccguggccagcagccuggcgcuggccaucaugauggccgggcucucccuguggaugugcagcaacggcucccugcagugccggaucugcaucuga

SEQ ID NO: 75007 - RNA, 1707 nt, Artificial Sequence; identical to SEQ ID NO: 70179
  derived and/or modified sequence opt1 from hemagglutinin__InfluenzaA__ABW06108

SEQ ID NO: 75008 - RNA, 1707 nt, Artificial Sequence
  derived and/or modified sequence opt1 from hemagglutinin__InfluenzaA__EPI341633
auggagaagaucacccugcuccugagcaucgugucccuggucaagagcgaccagaucugcaucggcuaccacgccaacaacuccaccgagcaggucgacacgaucauggagaagaacgugaccgugacccacgcccaggacauccucgagaagacccacaacgggaagcugugcgaccuggacggcgugaagccccucauccugaaggacugcagcguggcgggguggcugcucggcaacccgaugugcgacgaguucaucaacguccccgagugguccuacaucguggagaaggccaaccccacgaacgaccugugcuaccccgggagcuucaacgacuacgaggagcugaagcaccuccugucccgcaucaaccacuucgagaagauccagaucauccccaagagcuccuggagcgaccacgaggccuccagcggcguguccagcgccugccccuaccugggcucccccagcuucuuccggaacgucguguggcucaucaagaagaacuccaccuaccccaccaucaagaagaccuacaacaacacgaaccaggaggaccugcugauccucugggggauccaccacccgaacaacggcgccgagcagaccaugcuguaccagaaccccaccaccuacaucagcaucgggacguccacccugaaccagcgccucgugcccaagaucgcgacccggagcaaggucaacggccagagcgggcgcauggaguucuucuggaccauccugaagcccaacgacgccaucaacuucgaguccaacggcaacuucaucgccccggaguacgccuacaagaucgugaagaagggcgacagcgcgaucaugaaguccgagcuggaguacgggaacugcaacacgaagugccagacccccaugggcgccaucaacagcuccaugcccuuccacaacauccaccccaucaccaucggggagugcccgaaguacgucaagagcaaccggcucgugcuggccaccggccugcgcaacuccccgcagcgggagagccgccggaagaagcgcggccucuucggggccaucgccggcuucaucgagggcggguggcaggggaugguggacggcugguacggcuaccaccacuccaacgagcaggggagcggcuacgcggccgacaaggaguccacgcagaaggccaucgacggggugaccaacaaggucaacagcaucaucgacaagaugaacacccaguucgaggccgugggccgggaguucuccaaccuggagcgccggaucgagaaccugaacaagaagauggaggacggguuccucgacguguggaccuacaacgccgagcugcugguccucauggagaacgagcgcacgcuggacuuccacgacagcaacgugaagaaccuguacgacaaggugcggcuccagcugcgcgacaacgcgaaggagcugggcaacggcugcuucgaguucuaccacaagugcgacaacgagugcauggaguccauccggaacgggaccuacaacuacccccaguacagcgaggaggcccgccucaagcgggaggagaucuccggcgucaagcuggagagcaucgggaccuaccagauccuguccaucuacagcaccguggccagcucccucgcccuggccaucaugaucgcgggccugagccucuggaugugcuccaacgggagccugcagugccgcaucugcaucuga

SEQ ID NO: 75009 - RNA, 1707 nt, Artificial Sequence
  derived and/or modified sequence opt1 from hemagglutinin__InfluenzaA__ABD95991
auggagaagaucaugcugcuccuggccaucgugagccuggucaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguuccugaacguccccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccagcggcguguccagcgccugcccguaccagggccgcuccagcuucuuccggaacgucguguggcugaucaagaaggacaacgcguaccccaccaucaagcgcuccuacaacaacacgaaccaggaggaccugcuggugcucugggggauccaccaccccaacgacgccgccgagcagacccggcuguaccagaacccgaccaccuacaucagcgucggcacguccacccugaaccagcgccucgugcccaagaucgccacccggagcaaggugaacgggcaguccggccgcauggaguucuucuggaccauccugaagcccaacgacgcgaucaacuucgagagcaacgggaacuucaucgcccccgagaacgccuacaagaucgucaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcaaccggcuggugcuggccacggggcuccgcaacuccccgcagggcgagcggcgccggaagaagcgcggccuguucggggcgaucgccggcuucaucgagggcggguggcaggggaugguggacggcugguacggcuaccaccacagcaacgagcagggguccggcuacgccgccgacaaggagagcacccagaaggccaucgacggggugaccaacaaggugaacuccaucaucgacaagaugaacacccaguucgaggcggucggccgggaguucaacaaccuggagcgccggaucgagaaccucaacaagaagauggaggacggguuccuggacguguggacguacaacgccgagcugcucgugcugauggagaacgagcgcacccuggacuuccacgacagcaacgucaagaaccucuacgacaaggugcggcugcagcugcgcgacaacgccaaggagcucggcaacggcugcuucgaguucuaccaccggugcgacaacgagugcauggaguccguccgcaacgggaccuacgacuacccccaguacagcgaggaggcccgccugaagcgggaggagaucuccggcgugaagcuggagagcaucgggaccuaccagauccucuccaucuacagcacgguggccuccagccuggcgcuggccaucauggucgccggccucucccuguggaugugcagcaacgggagccugcagugccgcaucugcaucuga

SEQ ID NO: 75010 - RNA, 1707 nt, Artificial Sequence
  derived and/or modified sequence opt1 from hemagglutinin__InfluenzaA__AGN69453
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccgccggcgucagcuccgcgugcccguaccagggcaugagcuccuucuuccgcaacgugguguggcugaucaagaaggacaacgccuaccccaccaucaagcggagcuacaacaacacgaaccaggaggaccugcugguccucugggggauccaccaccccaacgacgccgccgagcagaccaagcuguaccagaacuccaccaccuacaucagcgugggcacguccacccugaaccagcgccucgugccgaagaucgcgacccggagcaaggucaacgggcaguccggccgcaucgaguucuucuggaccauccugaagcccaacgacacgaucaacuucgagagcaacgggaacuucaucgcccccgagaacgccuacaagaucgugaagaagggcgacagcaccaucaugaaguccgagcuggaguacggcaacugcaacaccaagugccagacccccaucggggccaucaacagcuccaugccguuccacaacauccacccccucacgaucggcgagugccccaaguacgucaagagcucccggcuggugcuggccaccgggcuccgcaacagcccccagggcgagcggcgccggaagaagcgcggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacgcaguucgaggcggugggccgggaguucaacaaccuggagcgccggaucgagaaccucaacaagaagauggaggacggguuccuggacguguggaccuacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccgcaguacuccgaggaggcccggcugaagcgcgaggagaucagcggcgugaagcuggaguccaucgggacguaccagauccucagcaucuacuccaccgucgccagcucccuggcgcuggccaucaugguggccggccucagccuguggaugugcagcaacgggucccugcagugccgcaucugcaucuga

SEQ ID NO: 75011 - RNA, 1707 nt, Artificial Sequence
  derived and/or modified sequence opt1 from hemagglutinin__InfluenzaA__AGN69452
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccgccggcgucagcuccgcgugcccguaccagggccgcagcuccuucuuccggaacgugguguggcugaucaagaaggacaacgccuaccccaccaucaagcgcagcuacaacaacacgaaccaggaggaccugcugguccucugggggauccaccaccccaacgacgccgccgagcagacccggcuguaccagaacuccaccaccuacaucagcgugggcacguccacccugaaccagcgccucgugccgaagaucgcgacccggagcaaggucaacgggcaguccggccgcaucgaguucuucuggaccauccugaagcccaacgacacgaucaacuucgagagcaacgggaacuucaucgcccccgagaacgccuacaagaucgugaagaagggcgacagcaccaucaugaaguccgagcuggaguacggcaacugcaacaccaagugccagacccccaucggggccaucaacagcuccaugccguuccacaacauccacccccucacgaucggcgagugccccaaguacgucaagagcucccggcuggugcuggccaccgggcuccgcaacagcccccagggcgagcggcgccggaagaagcgcggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacgcaguucgaggcggugggccgggaguucaacaaccuggagcgccggaucgagaaccucaacaagaagauggaggacggguuccuggacguguggaccuacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccgcaguacuccgaggaggcccgccugaagcgggaggagaucagcggcgugaagcuggaguccaucgggacguaccagauccucagcaucuacuccaccgucgccagcucccuggcgcuggccaucaugguggccggccucagccuguggaugugcagcaacgggucccugcagugccgcaucugcaucuga

SEQ ID NO: 75012 - RNA, 1707 nt, Artificial Sequence
  derived and/or modified sequence opt1 from hemagglutinin__InfluenzaA__ABD73284
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccgccggcgucagcuccgcgugcccguaccagggccgcagcuccuucuuccggaacgugguguggcugaucaagaaggacaacgccuaccccaccaucaagcgcagcuacaacaacacgaaccaggaggaccugcugguccucugggggauccaccaccccaacgacgccgccgagcagacccggcuguaccagaacccgaccaccuacaucuccgugggcacgagcacccugaaccagcgccucgugcccaagaucgcgacccgguccaaggucaacgggcagagcggccgcauggaguucuucuggaccauccugaagcccaacgacgccaucaacuucgaguccaacgggaacuucaucgcccccgagaacgccuacaagaucgugaagaagggcgacagcacgaucaugaaguccgagcuggaguacggcaacugcaacaccaagugccagaccccgaucggggccaucaacagcagcaugcccuuccacaacauccacccccucaccaucggcgagugccccaaguacgugaaguccagccggcugguccuggcgacggggcuccgcaacuccccgcagggcgagcggcgccggaagaagcgcggccuguucggggccaucgccggcuucaucgagggcggguggcaggggaugguggacggcugguacggcuaccaccacagcaacgagcagggguccggcuacgccgccgacaaggagagcacccagaaggcgaucgacggggugaccaacaaggucaacuccaucaucgacaagaugaacacccaguucgaggccgugggccgggaguucaacaaccuggagcgccggaucgagaaccucaacaagaagauggaggacggguuccuggacguguggacguacaacgccgagcugcucguccugauggagaacgagcgcacccuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacagcgaggaggcccgccugaagcgggaggagaucuccggcgugaagcuggagagcaucgggaccuaccagauccucuccaucuacagcacggucgcguccagccuggcccuggccaucaugguggccggccucucccuguggaugugcagcaacgggagccugcagugccgcaucugcaucuga

SEQ ID NO: 75013 - RNA, 1695 nt, Artificial Sequence
  derived and/or modified sequence opt1 from hemagglutinin__InfluenzaA__ABF93440
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccagaacccgaccaccuacaucagcgugggcacguccacccugaaccagcgccucgugcccaagaucgccacccggagcaaggucaacgggcaguccggccgcauggaguucuucuggaccauccugaagcccaacgacgcgaucaacuucgagagcaacgggaacuucaucgcccccgagaacgccuacaagaucgugaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcaaccggcuggugcuggccacggggcuccgcaacuccccgcagaucgagacccggggccuguucggcgcgaucgccggguucaucgagggcggguggcagggcaugguggacgggugguacggcuaccaccacagcaacgagcagggcuccggguacgccgccgacaaggagagcacccagaaggccaucgacggcgugaccaacaaggucaacuccaucaucgacaagaugaacacgcaguucgaggcgguggggcgcgaguucaacaaccuggagcggcgcaucgagaaccucaacaagaagauggaggacggcuuccuggacguguggaccuacaacgccgagcugcucguccugauggagaacgagcggacccuggacuuccacgacagcaacgugaagaaccucuacgacaagguccgccugcagcugcgggacaacgccaaggagcucgggaacggcugcuucgaguucuaccaccgcugcgacaacgagugcauggaguccgugcggaacggcaccuacgacuacccccaguacagcgaggaggcccgccugaagcgggaggagaucuccggggugaagcuggagagcaucggcacguaccagauccucuccaucuacagcaccgucgccuccagccuggcgcuggccaucaugguggccgggcucucccuguggaugugcagcaacggcagccugcagugccgcaucugcaucuga

SEQ ID NO: 75014 - RNA, 1701 nt, Artificial Sequence
  derived and/or modified sequence opt1 from hemagglutinin__InfluenzaA__AKC45369
auggagaagaucgugcugcuccuggccgucgugagccuggugaaguccgaccagaucugcaucggcuaccacgccaacaacagcaccgagcaggucgacaccaucauggagaagaacgugacggugacccacgcgcaggacauccucgagaagacccacaacgggcgccugugcgaccugaacggcgucaagccccucauccugaaggacugcuccguggccggguggcugcucggcaacccgaugugcgacgaguucauccgggugcccgaguggagcuacaucgucgagcgcgccaaccccgccaacgaccugugcuaccccgggaaccugaacgacuacgaggagcucaagcaccuccugucccggaucaaccacuucgagaagacccugaucauccccaagagcuccuggccgaaccacacgagcuccggcgugagcgccgcgugccccuaccagggcacccccuccuucuuccgcaacguggucuggcugaccaagaagaacgacgccuacccgaccaucaagaugagcuacaacaacacgaaccgggaggaccugcucauccugugggggauccaccacuccaacaacgccgccgagcagaccaaccuguacaagaaccccaccaccuacgugagcgugggcacguccacccucaaccagcgccugguccccaagaucgcgacccggagccaggugaacgggcagcgcggccggauggacuucuucuggaccauccugaagcccaacgacgccauccacuucgaguccaacgggaacuucaucgccccggaguacgccuacaagaucgugaagaagggcgacagcacgaucaugaaguccgagauggaguacggccacugcaacaccaagugccagacccccaucggggccaucaacagcagcaugcccuuccacaacauccacccccucaccaucggcgagugcccgaaguacgucaaguccaacaagcuggugcuggcgacggggcuccgcaacagcccccugcgggagcgccggcgcaagcggggccuguucggcgccaucgccggguucaucgagggcggguggcagggcaugguggacgggugguacggcuaccaccacuccaacgagcagggcagcggguacgccgccgaccgcgaguccacccagaaggcgaucgacggcgucaccaacaaggugaacagcaucaucgacaagaugaacacccaguucgaggccguggggcgggaguucaacaaccucgagcgccggaucgagaaccugaacaagaagauggaggacggcuuccuggacgucuggacguacaacgccgagcuccuggugcugauggagaacgagcgcacccucgacuuccacgacuccaacgucaagaaccuguacgacaaggugcggcugcagcuccgcgacaacgccaaggagcuggggaacggcugcuucgaguucuaccacaagugcgacaacgagugcauggagagcgugcgcaacggcaccuacgacuacccccaguacuccgaggaggcccggcugaagcgcgaggagaucagcggggucaagcucgaguccaucggcaccuaccagauccugagcaucuacuccacgguggcgagcucccuggcccucgccaucaucguggccgggcugagccuguggaugugcuccaacggcagccuccagugccggaucugcaucuga

SEQ ID NO: 75015 - RNA, 1704 nt, Artificial Sequence; identical to SEQ ID NO: 73966
  derived and/or modified sequence opt1 from hemagglutinin__InfluenzaA__AJS18479

SEQ ID NO: 75016 - RNA, 1704 nt, Artificial Sequence
  derived and/or modified sequence opt1 from hemagglutinin__InfluenzaA__EPI691378
auggagaagaucgugcugcuccuggccgucgugagccuggugaaguccgaccagaucugcaucggcuaccacgccaacaacagcaccgagcaggucgacaccaucauggagaagaacgugacggugacccacgcgcaggacauccucgagaagacccacaacgggcgccugugcgaccugaacggcgucaagccccucauccugaaggacugcuccguggccggguggcugcucggcaacccgaugugcgacgaguucauccgggugcccgaguggagcuacaucgucgagcgcgccaaccccgccaacgaccugugcuaccccgggaaccugaacgacuacgaggagcucaagcaccuccugucccggaucaaccacuucgagaagacccugaucauccccaagagcuccuggccgaaccacgagacgagccugggcguguccgccgcgugccccuaccagggcgugcccagcuucuuccgcaacgucguguggcugaccaagaagaacgacgccuacccgaccaucaagauguccuacaacaacaccaaccgggaggaccuccugauccugugggggauccaccacagcaacaacgccgccgagcagacgaaccucuacaagaaccccaccaccuacguguccgucggcaccagcacgcugaaccagcgccuggugcccaagaucgcgacccggucccaggugaacgggcagcgcggccggauggacuucuucuggaccauccucaagcccaacgacgccauccacuucgagagcaacgggaacuucaucgccccggaguacgccuacaagaucgucaagaagggcgacuccaccaucaugaaguccgagauggaguacggccacugcaacacgaagugccagacccccaucggggccaucaacuccagcaugcccuuccacaacauccacccccugaccaucggcgagugcccgaaguacgucaagagcaacaagcuggugcucgcgaccgggcugcgcaacagcccccugcgggagcgccggcgcaagcggggccucuucggcgccaucgccggguucaucgagggcggguggcagggcaugguggacgggugguacggcuaccaccacagcaacgagcagggcuccggguacgccgccgaccgcgagagcacgcagaaggcgaucgacggcgugaccaacaaggugaacuccaucaucgacaagaugaacacccaguucgaggccgucgggcgggaguucaacaaccuggagcgccggaucgagaaccugaacaagaagauggaggacggcuuccucgacguguggaccuacaacgccgagcugcugguccucauggagaacgagcgcacgcuggacuuccacgacagcaacgugaagaaccuguacgacaaggugcggcuccagcugcgcgacaacgccaaggagcuggggaacggcugcuucgaguucuaccacaagugcgacaacgagugcauggaguccguccgcaacggcaccuacgacuacccccaguacagcgaggaggcccggcucaagcgcgaggagaucuccggggugaagcuggagagcaucggcaccuaccagauccuguccaucuacagcaccguggcguccagccucgcccuggccaucaucgucgccgggcugucccucuggaugugcagcaacggcucccugcagugccggaucugcaucuga

SEQ ID NO: 75017 - RNA, 1704 nt, Artificial Sequence
  derived and/or modified sequence opt1 from hemagglutinin__InfluenzaA__EPI533583
auggagaagaucgugcugcuccuggccaucgucagccuggugaagggcgaccagaucugcaucggguaccacgccaacaacuccaccgagcaggucgacaccaucauggagaagaacgugacggugacccacgcgcaggacauccucgagaagacccacaacggcaagcugugcgaccugaacggggugaagccccucauccugaaggacugcagcgucgccggcuggcugcucgggaacccgaugugcgacgaguucauccgcgugcccgagugguccuacaucguggagcgggccaaccccgccaacgaccugugcuaccccggcaaccugaacgacuacgaggagcucaagcaccuccugagccgcaucaaccacuucgagaagauccugaucaucccgaaguccagcuggaccaaccacgagacgucccugggcgucagcgccgcgugccccuaccaggggacccccuccuucuuccggaacgugguguggcugaucaagaagaacgacgccuaccccaccaucaagaucagcuacaacaacaccaaccaggaggaccuccugauccuguggggcguccaccacuccaacaacgccgccgagcagacgaaccucuacaagaacccgaccaccuacaucagcguggggaccuccacgcugaaccagcgccuggugcccaagaucgcgacccggagccaggucaacggccagcgcgggcggauggacuucuucuggaccauccucaagcccaacgacgccauccacuucgaguccaacggcaacuucaucgcccccgaguacgccuacaagaucgugaagaagggcgacagcaccaucaugaaguccgagauggaguacgggcacugcaacacgaagugccagaccccgaucggcgccaucaacagcuccaugcccuuccacaacauccacccccugaccaucggggagugccccaaguacgucaagagcaacaagcuggugcucgcgaccggccugcgcaacagcccgcugcgggagaagcgccggaagcgcggccucuucggggccaucgccggcuucaucgagggcggguggcaggggaugguggacggcugguacggcuaccaccacuccaacgagcaggggagcggcuacgccgccgacaaggaguccacgcagaaggcgaucgacggggugaccaacaaggucaacagcaucaucgacaagaugaacacccaguucgaggccgugggccgggaguucaacaaccuggagcgccggaucgagaaccugaacaagaagauggaggacggguuccucgacguguggaccuacaacgccgagcugcugguccucauggagaacgagcgcacgcuggacuuccacgacuccaacgugaagaaccuguacgacaagguccggcuccagcugcgcgacaacgccaaggagcugggcaacggcugcuucgaguucuaccacaagugcgacaacaagugcauggagagcgugcggaacgggaccuacgacuacccccaguacuccgaggaggcccgccucaagcgggaggagaucagcggcgugaagcuggaguccaucgggaccuaccagauccugagcaucuacuccaccgucgcgagcucccucgcccuggccaucaucguggccggccugagccucuggaugugcuccaacgggagccugcagugccgcaucugcaucuga

SEQ ID NO: 75018 - RNA, 1701 nt, Artificial Sequence; identical to SEQ ID NO: 73979
  derived and/or modified sequence opt1 from hemagglutinin__InfluenzaA__AKS48023

SEQ ID NO: 75019 - RNA, 1701 nt, Artificial Sequence
  derived and/or modified sequence opt1 from hemagglutinin__InfluenzaA__EPI587621
auggagaagauggugcugcuccuggccgccgucagccuggugaaguccgaccagaucugcaucggcuaccacgcgaacaacagcaccgagcaggucgacaccaucauggagaagaacgugacggugacccacgcccaggacauccucgagaagacccacaacgggcgccugugcgaccugaacggcgugaagccccucauccugaaggacugcuccgucgccggguggcugcucggcaacccgaugugcgacgaguucauccgggugcccgaguggagcuacaucguggagcgcgccaaccccgccaacgaccugugcuaccccgggaaccugaacgacuacgaggagcucaagcaccuccugucccggaucaaccacuucgagaagacccugaucauccccaagagcuccuggccgaaccacacgagcuccggcgucagcgcggccugccccuaccagggcaugcccuccuucuuccgcaacgugguguggcugaccaagaagaacgacgccuacccgaccaucaagaugagcuacaacaacaccuaccgggaggaccugcucauccugugggggauccaccacuccaacaacgccgcggagcagacgaaccuguacaagaaccccaccaccuacgucagcgugggcaccuccacgcucaaccagcgccuggagcccaagaucgccacccggagccaggugaacgggcagcgcggccggauggacuucuucuggaccauccugaagcccaacgacgccauccacuucgaguccaacgggaacuucaucgccccggaguacgccuacaagaucgucaagaagggcgacagcaccaucaugaaguccgagauggaguacggccacugcaacacgaagugccagacccccaucggggcgaucaacagcagcaugcccuuccacaacauccacccccucaccaucggcgagugcccgaaguacgugaaguccaacaagcuggugcuggccaccgggcuccgcaacagcccccugcgggagcgccggcgcaagcggggccuguucggcgccaucgccggguucaucgagggcggguggcagggcauggucgacgggugguacggcuaccaccacuccaacgagcagggcagcggguacgccgcggaccgcgaguccacgcagaaggccaucgacggcgugaccaacaaggugaacagcaucaucgacaagaugaacacccaguucgaggccgucgggcgggaguucaacaaccucgagcgccggaucgagaaccugaacaagaagauggaggacggcuuccuggacguguggaccuacaacgccgagcuccuggugcugauggagaacgagcgcacgcucgacuuccacgacuccaacgucaagaaccuguacgacaaggugcggcugcagcuccgcgacaacgccaaggagcuggggaacggcugcuucgaguucuaccacaagugcgacaacgagugcauggagagcguccgcaacggcaccuacgacuacccccaguacuccgaggaggcgcggcugaagcgcgaggagaucagcggggugaagcucgaguccaucggcaccuaccagauccugagcaucuacuccaccguggccagcucccuggcccucgccaucaucgucgccgggcugagccuguggaugugcuccaacggcagccuccagugccggaucugcaucuga

SEQ ID NO: 75020 - RNA, 1704 nt, Artificial Sequence
  derived and/or modified sequence opt1 from hemagglutinin__InfluenzaA__AJE30333
auggagaagaucgugcugcuccuggccgucaucagccuggugaaguccgaccagaucugcaucggcuaccacgccaacaacagcaccaagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggacccugaacgacuacgaggagcucaagcaccuccugucccgcaucaaccacuucgagaagacgcugaucaucccgcggagcuccuggcccaaccacgagaccagccugggcgucuccgccgcgugccccuaccagggcgccagcuccuucuuccgcaacgugguguggcugaucaagaagaacgacgccuaccccaccaucaagaucagcuacaacaacaccaaccgggaggaccuccugauccugugggggauccaccacuccaacaacgccgcggagcagacgaaccucuacaagaacccggacaccuacgucagcgugggcaccuccacccugaaccagcgccuggugcccaagaucgccacgcggagccaggucaacgggcaguccggccgcauggacuucuucuggaccauccucaagcccaacgacgccauccacuucgagagcaacgggaacuucaucgcccccgaguacgccuacaagaucgugaagaagggcgacuccaccaucaugaaguccgagauggaguacggccacugcaacaccaagugccagacgccgaucggggcgaucaacagcagcaugcccuuccacaacauccacccccugaccaucggcgagugccccaaguacgucaagagcaacaagcuggugcucgccaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgcggacaaggagagcacccagaaggccaucgacggcgugacgaacaaggucaacuccaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcacguacgacuaccccaaguacagcgaggaggcgauccucaagcgcgaggagaucuccggggugaagcuggagagcaucggcaccuaccagauccuguccaucuacagcaccgucgccuccagccucgcccuggccaucaucguggccgggcugucccucuggaugugcagcaacggcucccugcagugccgcaucugcaucuga

SEQ ID NO: 75021 - RNA, 1704 nt, Artificial Sequence
  derived and/or modified sequence opt1 from hemagglutinin__InfluenzaA__EPI459855
augaucgccaucguggucaucgccauccuggcgagcgccggcaaguccgacaagaucugcaucggguaccacgccaacaacagcaccacccagguggacacgcuccuggagaagaacgugaccgucacccacuccguggagcugcucgagaaccagaaggagaagcgcuucugcaagaucaugaacaaggcgccccuggaccugaaggacugcaccaucgagggcuggauccucgggaacccgaagugcgaccugcugcucggcgaccagagcugguccuacaucguggagcggcccaacgcccagaacgggaucugcuaccccggcguccugaacgagcuggaggagcucaaggccuucaucggcagcggggagcgcguggagcgguucgagauguuccccaaguccacgugggccggcguggacaccagccgcggggucaccaacgccugcccguccuacaccaucgacagcuccuucuaccggaaccugguguggaucgugaagacggacagcgccaccuaccccgucaucaagggcaccuacaacaacaccgggacgcagcccauccuguacuucuggggcgugcaccacccccucgacaccaccgugcaggacaaccuguacggcuccggggacaaguacguccgcaugggcaccgagagcaugaacuucgcgaaguccccggagaucgccgcccggcccgccgugaacgggcagcgcagccggaucgacuacuacugguccgugcugcgccccggcgagacgcucaacgucgagagcaacggcaaccugaucgcccccugguacgcguacaaguucguguccaccaacaagaagggggccguguucaagagcgaccugccgaucgagaacugcgacgcgaccugccagaccaucacgggcguccuccggaccaacaagaccuuccagaacgugagcccccuguggaucggggagugccccaaguacgugaaguccgagagccugcgccucgccaccggccugcggaacgucccccagaucgccacgcgcgggaucuucggcgccaucgccggcuucaucgagggcggguggaccgggaugaucgacggcugguacggguaccaccacgagaacucccagggcagcggcuacgccgccgaccgggaguccacccagaaggccaucgacgggaucaccaacaaggugaacagcaucaucaacaagaugaacacgcaguucgaggcggucgaccacgaguucuccaaccuggagcgccggaucggcaaccucaacaagcgcauggaggacggguuccuggacguguggaccuacaacgccgagcugcucgugcugcuggagaacgagcggacccucgaccugcacgacgccaacgucaagaaccuguacgagaaggucaagagccagcuccgcgacaacgccaacgaccugggcaacgggugcuucgaguucuggcacaagugcgacaacgagugcauggaguccgugaagaacggcaccuacgacuacccgaaguaccagaaggagagcaagcugaaccggcagggcaucgaguccgugaagcucgagaaccuggggguguaccagauccuggccaucuacagcacgguguccagcucccucguccuggugggccugaucauggcgaucgggcucuggaugugcagcaacggcuccaugcagugccgcaucugcaucuga

SEQ ID NO: 75022 - RNA, 1704 nt, Artificial Sequence; identical to SEQ ID NO: 75021
  derived and/or modified sequence opt1 from hemagglutinin__InfluenzaA__EPI459855/m1

SEQ ID NO: 75023 - RNA, 1692 nt, Artificial Sequence
  derived and/or modified sequence opt1 from hemagglutinin__InfluenzaA__ACZ36872
augaacacccagauccugguguucgcccucgucgccgugauccacaccaacgcggacaagaucugccugggccaccacgccgugagcaacgggacgaaggucaacacccugaccgagcgcggcguggagguggucaacgccaccgagacgguggagcggaccaacauccccaagaucugcuccaaggggaagcgcaccguggaccucggccagugcgggcugcugggcaccaucacgggcccgccccagugcgaccaguuccucgaguucagcgccgaccugaucaucgagcggcgcgacgggaacgacgucugcuaccccggcaaguucgugaacggggaggcccugcggcagauccuccgcaaguccggcgggaucaacaaggagaccaugggcuucaccuacagcggcauccggaccaacgggacgaccuccgcgugccgccggagcggcuccagcuucuacgccgagaugaaguggcugcuguccgacaccgacaacgccgccuucccccagaugaccaagagcuacaagaacacgcgccgggagccggcgcucaucgugugggggauccaccacuccggcagcaccaccgagcagaccaagcuguacggcuccgggaacaagcuggucacggugggcagcuccaaguaccagcagagcuucgugcccucccccgggacccgcccccaggucaacggccagagcgggcggaucgacuuccacuggcucauccuggacuccaacgacaccgugaccuucagcuucaacggcgccuucaucgccccggaccgcgccagcuuccugaagggcaaguccauggggauccagagcgacgugcaggucgacgccaacugcgagggcgagugcuaccacuccgggggcacgaucaccagcucccuccccuuccagaacaucaacagccgggcgguggggaagugcccccgcuacgugaagcaggagucccugcugcucgccaccggcaugaagaacguccccgagcugccgaagaagcggcgcaagcggggccuguucggggccaucgccggcuucaucgagaacgggugggagggccucguggacgggugguacggcuuccgccaccagaacgcccagggcgaggggaccgcggccgacuacaagagcacgcaguccgccaucgaccagaucaccggcaagcugaaccggcugaucgagaagaccaaccagcaguucgagcucaucgacaacgaguucaccgagguggagaagcagaucgggaacgucaucaacuggacgcgcgacagcaucaccgaggugugguccuacaacgccgagcugcuggucgccauggagaaccagcacaccaucgaccucgcggacagcgagaugaacaagcuguacgagcgcgugcggaagcagcugcgcgagaacgccgaggaggacggcaccggcugcuucgagaucuuccacaagugcgacgacgacugcauggccuccauccggaacaacacguacgaccacagcaaguaccgcgaggaggccaugcagaaccggauccagaucgaccccgugaagcucuccgggggcuacaaggacgucauccugugguucagcuucggggccuccugcuuccugcuccuggcgaucgccaugggccugguguucaucugcgugaagaacgggaacaugcgcugcaccaucugcaucuga

SEQ ID NO: 75024 - RNA, 1692 nt, Artificial Sequence
  derived and/or modified sequence opt1 from hemagglutinin__InfluenzaA__AGB51388
augaacacccagauccugguguucgcccucgucgccgugauccacaccaacgcggacaagaucugccugggccaccacgccgugagcaacgggacgaaggucaacacccugaccgagcgcggcguggagguggucaacgccaccgagacgguggagcggaccaacauccccaagaucugcuccaaggggaagcgcaccguggaccucggccagugcgggcugcugggcaccaucacgggcccgccccagugcgaccaguuccucgaguucagcgccgaccugaucaucgagcggcgcgacgggaacgacgucugcuaccccggcaaguucgugaacggggaggcccugcggcagauccuccgcaaguccggcgggaucaacaaggagaccaugggcuucaccuacagcggcauccggaccaacgggacgaccuccgcgugccgccggagcggcuccagcuucuacgccgagaugaaguggcugcuguccgacaccgacaacgccgccuucccccagaugaccaagagcuacaagaacacgcgccgggagccggcgcucaucgugugggggauccaccacuccggcagcaccaccgagcagaccaagcuguacggcuccgggaacaagcuggucacggugggcagcuccaaguaccagcagagcuucgugcccaaccccgagacccgcccccaggucaacgggcaguccggccggaucgacuuccacuggcucauccuggacagcaacgacaccgugaccuucuccuucaacggggccuucaucgccccggaccgcgccagcuuccugaagggcaagagcaugggcauccaguccgacgugcaggucgacgccaacugcgagggggagugcuaccacagcggcgggacgaucaccuccagccuccccuuccagaacaucaacucccgggcggugggcaagugcccccgcuacgugaagcaggagagccugcugcucgccaccgggaugaagaacguccccgagcugccgaagaagcggcgcaagcggggccuguucggcgccaucgccggguucaucgagaacggcugggaggggcucguggacggcugguacggguuccgccaccagaacgcccagggcgagggcaccgcggccgacuacaaguccacgcagagcgccaucgaccagaucaccgggaagcugaaccggcugaucgagaagaccaaccagcaguucgagcucaucgacaacgaguucaccgagguggagaagcagacgggcaacgucaucaacuggacccgcgacuccaucaccgagguguggagcuacaacgccgagcugcuggucgccauggagaaccagcacaccaucgaccucgcggacuccgagaugaacaagcuguacgagcgcgugcggaagcagcugcgcgagaacgccgaggaggacgggacgggcugcuucgagaucuuccacaagugcgacgacgacugcauggccagcauccggaacaacaccuacgaccacuccaaguaccgcgaggaggccaugcagaaccggauccagaucgaccccgugaagcucagcggcggguacaaggacgucauccugugguucuccuucggcgccagcugcuuccugcuccuggcgaucgccauggggcugguguucaucugcgugaagaacggcaacaugcgcugcaccaucugcaucuga

SEQ ID NO: 75025 - RNA, 1683 nt, Artificial Sequence; identical to SEQ ID NO: 70996
  derived and/or modified sequence opt1 from hemagglutinin__InfluenzaA__EPI439507

SEQ ID NO: 75026 - RNA, 1704 nt, Artificial Sequence
  derived and/or modified sequence opt1 from hemagglutinin__InfluenzaA__EPI164216
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggaggaccuccugauccugugggggauccaccacuccaacgacgccgccgagcagaccaagcucuaccagaacccgacgaccuacaucagcgucggcaccuccacccugaaccagcgccuggugcccaagaucgccacgcggagcaaggugaacgggcaguccggccgcauggacuucuucuggaccauccucaagcccaacgacgcgaucaacuucgagagcaacgggaacuucaucgcccccgaguacgccuacaagaucgucaagaagggcgacagcgccaucgugaaguccgagguggaguacggcaacugcaacaccaagugccagaccccgaucggggccaucaacagcuccaugcccuuccacaacauccacccccugacgaucggcgagugccccaaguacgucaagagcaacaagcuggugcucgcgaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgucaccaacaaggugaacuccaucaucgacaagaugaacacgcaguucgaggccguggggcgggaguucaacaaccuggagcgccggaucgagaaccugaacaagaagauggaggacggcuuccucgacgucuggaccuacaacgccgagcugcuggugcucauggagaacgagcgcacccuggacuuccacgacagcaacgucaagaaccuguacgacaaggugcggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggucaagcuggagagcaucggcacguaccagauccuguccaucuacagcaccguggcguccagccucgcccuggccaucaugguggccgggcugucccucuggaugugcagcaacggcagccugcagugccgcaucugcaucuga

SEQ ID NO: 75027 - RNA, 1683 nt, Artificial Sequence; identical to SEQ ID NO: 73359
  derived and/or modified sequence opt1 from hemagglutinin__InfluenzaA__EPI486492

SEQ ID NO: 75028 - RNA, 1683 nt, Artificial Sequence
  derived and/or modified sequence opt1 from hemagglutinin__InfluenzaA__EPI740738
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggagaccaugggguucaccuacuccggcauccgcaccaacggcgucacgagcgcgugcaagcgguccgggagcuccuucuacgccgagaugaaguggcugcugagcaacaccgacaacgccgccuucccccagaugaccaaguccuacaagaacacccgcaagagccccgcgaucaucguguggggcauccaccacuccgugagcacggccgagcagaccaagcucuacggguccggcaacaagcuggucaccgugggcagcuccaacuaccagcagagcuucgugcccucccccggggcccggccgcaggucaacggccugagcgggcgcaucgacuuccacuggcucauccugaaccccaacgacaccgugacguucagcuucaacggcgccuucaucgcccccgaccgggcguccuuccugcgcggcaagagcauggggauccaguccggcgugcaggucgacgccaacugcgagggggacugcuaccacagcggcgggaccaucaucuccaaccuccccuuccagaacaucgacagccgggccgugggcaagugcccgcgcuacgugaagcagcggucccugcugcucgccaccgggaugaagaacguccccgagauccccaagggccgcggccuguucggggccaucgcgggcuucaucgagaacgggugggagggccugaucgacgggugguacggcuuccggcaccagaacgcccagggcgaggggaccgccgccgacuacaagagcacgcaguccgccaucgaccagaucaccggcaagcucaaccgccugaucgcgaagaccaaccagcaguucgagcugaucgacaacgaguucaacgagguggagaagcagaucgggaacgugaucaacuggacccgggacagcaucacggaggucugguccuacaacgccgagcuccugaucgccauggagaaccagcacaccaucgaccuggccgacagcgagauggacaagcucuacgagcgcgugaagcgccagcugcgggagaacgccgaggaggacggcaccggcugcuucgagaucuuccacaagugcgacgacgacugcauggcguccauccgcaacaacaccuacgaccaccggaaguaccgcgaggaggccaugcagaaccggauccagaucgaccccgucaagcugagcuccggguacaaggacgugauccucugguucagcuucggcgccuccugcuucauccugcuggccaucgugauggggcucgucuucaucugcgugaagaacggcaacaugcgcugcacgaucugcaucuga

SEQ ID NO: 75029 - RNA, 1683 nt, Artificial Sequence
  derived and/or modified sequence opt1 from hemagglutinin__InfluenzaA__EPI730495
augaacauccagauccugguguucgcccucaucgccaucauccccaccgacgcggacaagaucugccugggccaccacgccgucagcaacgggaccaaggugaacacgcugaccgagcgcggcguggaggucgugaacgccaccgagaccguggagcggacgaacaucccgcgcaucugcuccaaggggaagcggaccgucgaccucggccagugcgggcugcugggcaccaucaccggcccgccccagugcgaccaguuccucgaguucagcgccgaccugaucaucgagcgccgggagggguccgacgugugcuaccccggcaaguucgugaacgaggaggcccugcgccagauccuccgcaagagcgggggcaucgacaaggaggcgaugggguucacguacuccggcauccggaccaacggcgccaccagcgccugccggcgcuccgggagcuccuucuacgccgagaugaaguggcugcugagcaacaccgacaacgcggccuucccgcagaugacgaaguccuacaagaacacccgcaagagccccgccaucaucgucuggggcauccaccacuccgugagcaccgccgagcagaccaagcucuacggguccggcagcaagcuggugacggucggcuccagcaacuaccagcaguccuucgugcccagccccggggcccggccccaggugaacggccugagcgggcggaucgacuuccacuggcucauccugaaccccaacgacaccgucaccuucuccuucaacggcgcguucaucgcccccgaccgcgccagcuuccugcgggggaaguccaugggcauccagagcggcguccagguggacgccgacugcgagggggacugcuaccacuccggcgggaccaucaucagcaaccuccccuuccagaacaucgacucccgcgccgugggcaagugcccgcgguacgugaagcagcgcagccugcugcucgcgacggggaugaagaacgugcccgagauccccaagggccggggccuguucggggccaucgccggcuucaucgagaacgggugggagggccugaucgacgggugguacggcuuccgccaccagaacgcccagggcgaggggaccgccgcggacuacaaguccacccagagcgccaucgaccagaucaccggcaagcucaaccggcugaucgagaagacgaaccagcaguucgagcugaucgacaacgaguucaucgaggucgagaagcagaucgggaacgugaucaacuggacccgcgacuccaucaccgagguguggagcuacaacgccgagcuccuggucgccauggagaaccagcacaccaucgaccuggccgacuccgagauggacaagcucuacgagcgcgugaagcggcagcugcgcgagaacgcggaggaggacggcacgggcugcuucgagaucuuccacaagugcgacgacgacugcauggccagcauccggaacaacaccuacgaccacuccaaguaccgcgaggaggccaugcagaaccggauccagaucgaccccgucaagcugagcuccggguacaaggacgugauccucugguucagcuucggcgccuccugcuucauccugccggcgaucgugauggggcuggucuucaugugcgugaagaacggcaacaugcgcugcaccaucugcaucuga

SEQ ID NO: 75030 - RNA, 1683 nt, Artificial Sequence
  derived and/or modified sequence opt1 from hemagglutinin__InfluenzaA__EPI712926
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggagaccaugggguucaccuacaacggcauccgcaucaacggcgucaccuccgcgugcaagcggagcggguccagcuucuacgccgagaugaaguggcugcuguccaacacggacaacgccgccuucccccagaugaccaagagcuacaagaacacccgcaagucccccgcgaucaucguguggggcauccaccacagcguguccaccgccgagcagacgaagcucuacgggagcggcaacaagcuggucaccgugggcuccagcaacuaccagcaguccuucgugcccagccccggggcccggccgcaggucaacggccuguccgggcgcaucgacuuccacuggcucauccugaaccccaacgacaccgugaccuucagcuucaacggcgccuucaucgcccccgaccgggcgagcuuccugcgcgggaaguccaucggcauccagagcggcgugcaggucgacgccaacugcgagggggacugcuaccacuccggcgggacgaucaucagcaaccuccccuuccagaacaucgacucccgggccgugggcaagugcccgcgcuacgugaagcagcggagccugcugcucgccaccgggaugaagaacguccccgagauccccaagggccgcggccuguucggggccaucgcgggcuucaucgagaacgggugggagggccugaucgacgggugguacggcuuccggcaccagaacgcccagggcgaggggaccgccgccgacuacaaguccacccagagcgccaucgaccagaucacgggcaagcucaaccgccugaucgcgaagaccaaccagcaguucgagcugaucgacaacgaguucaacgagguggagaagcagaucgggaacgugaucaacuggacccgggacuccaucaccgaggucuggagcuacaacgccgagcuccugaucgccauggagaaccagcacacgaucgaccuggccgacuccgagauggacaagcucuacgagcgcgugaagcgccagcugcgggagaacgccgaggaggacggcaccggcugcuucgagaucuuccacaagugcgacgacgacugcauggcgagcauccgcaacaacaccuacgaccaccggaaguaccgcgaggaggccaugcagaaccggauccagaucgaccccgucaagcuguccagcggguacaaggacgugauccucugguucuccuucggcgccagcugcuucauccugcuggccaucgugauggggcucgucuucaucugcgugaagaacggcaacaugcgcugcaccaucugcaucuga

SEQ ID NO: 75031 - RNA, 1683 nt, Artificial Sequence; identical to SEQ ID NO: 70996
  derived and/or modified sequence opt1 from hemagglutinin__InfluenzaA__AGL44438

SEQ ID NO: 75032 - RNA, 1683 nt, Artificial Sequence
  derived and/or modified sequence opt1 from hemagglutinin__InfluenzaA__EPI445996
auggagaccgugagccugaugaccauccuccugcuggucacgaccuccaacgccgacaagaucugcaucggccaccagagcaccaacuccaccgagacgguggacacccucaccgagaccaacgugcccgucacgcacgccaaggagcugcugcacaccgaccacaacgggaugcucugcgcgaccaaccugggccacccgcugauccucgacacgugcaacguggaggggcugaucuacggcaaccccagcugcgaccugcuccucgggggccgcgagugguccuacaucguggagcggcccagcgccgucaacgggaccugcuaccccggcaacguggagaaccuggaggagcugcgcacccuguucuccagcuccagcuccuaccagcggauccagaucuucccggacaccaucuggaacgugaccuacacgggcaccagcaaguccugcagcgacuccuucuaccgcaacaugcgguggcugacccagaagaacgggcucuaccccguccaggacgcccaguucaccaacaaccgcggcaaggacauccuguucgugugggggauccaccacccgcccacggacaccgcccagaccaaccuguacacccggacggacaccaccaccagcgugacgaccgagaaccucgaccgcaccuucaagccccugaucggcccccggccccuggucaacggccucaucgggcgcaucaacuacuacugguccgugcugaagcccggccagacccugcgggugcgcagcaacgggaaccucaucgccccgugguacggccacguccuguccggcgagagccacgggcggauccugaagacgaaccucaacagcggcaacugcguggugcagugccagaccgagaagggcgggcugaacuccacccugcccuuccacaacaucagcaaguacgcguucgggaacugccccaaguacaucggcgucaagucccucaagcuggccaucggccugcgcaacgugcccgccaagagcucccggggccucuucggggccaucgcgggguucaucgagggcggguggccgggccugguggccggcugguacggguuccagcacagcaacgaccagggcgucgggaucgccgccgaccgcguguccacccagaaggccguggacaagaucacgagcaaggucaacaacaucguggacaagaugaacaagcaguacgagaucaucgaccacgaguucuccgaggucgagacccggcugaacaugaucaacaacaagaucgacgaccagauccaggacgugugggcguacaacgccgagcuccuggugcugcucgagaaccagaagacccuggacgagcacgacgccaacgucaacaaccuguacaacaaggugaagcgcgcccucggcagcaacgcccuggaggacgggaagggcugcuucgagcuguaccacaagugcgacgaccagugcauggagaccauccggaacggcaccuacaaccgccggaaguaccaggaggagucccgccucgagcgccagaagaucgaggggaucaagcuggagagcgagggcacguacaagauccugaccaucuacuccaccguggcgagcucccugguccucgccaugggguucgccgccuuccuguucugggccaugagcaacggcuccugccggugcaacaucugcaucuga

SEQ ID NO: 75033 - RNA, 1695 nt, Artificial Sequence
  derived and/or modified sequence opt1 from hemagglutinin__InfluenzaA__EPI433309
auggagaagaucgugcugcuccuggccaucgccagccuggucaaguccgaccagaucugcaucggcuaccacgcgaacaacagcaccgagcaggucgacaccaucauggagaagaacgugacggugacccacgcccaggacauccucgagaagacccacaacgggaagcugugcgaccuggacggcgugaagccccucauccugcgcgacugcuccguggccggguggcugcucggcaacccgaugugcgacaaguucaacgacguccccgaguggagcuacaucguggagaaggccaaccccgccaacgaccugugcuaccccgggaaccugaacgacuacgaggagcucaagcaccuccugucccggaucaaccacuucgagaagauccagaccuuccccaagagcuccuggagcgaccacgaggcgucccugggcgugagcgccgccugccccuaccagggcaugcccuccuucuuccgcaacgucguguggcugaucaagaagaacaacacguaccccaccaucaagagcuccuacaacaacaccaaccaggaggaccugcucauccugugggggauccaccacagcaacgacgaggccgagcagacccggcuguaccagaacuccaacacguacaucagcgugggcaccuccacccucaaccagcgccuggucccgaagaucgcgacccggagcaaggugaacgggcaguccggccgcauggacuucuucuggacgauccugaagcccaacgacgccaucaacuucgagagcaacgggaacuucaucgcccccgaguacgccuacaagaucgugaagaagggcgacagcgccaucaugaaguccgaggucggcuacggggacugcaacaccaagugccagacccccaucggcgcgaucaacagcuccaugccguuccacaacauccacccccucaccaucggggagugccccaaguacgucaagagcaacaagcuggugcuggccacgggccuccggaacuccccgcagaucgagacccgcggccuguucggggccaucgccggcuucaucgagggcggguggcaggggaugguggacggcugguacggcuaccaccacagcaacgagcagggguccggcuacgccgcggacaaggagagcacccagaaggccaucgacggggugaccaacaaggugaacuccaucaucgacaagaugaacacgcaguucgaggccgucgagcgggaguucaacaaccuggagcgccggaucgagaaccucaacaagaagauggaggacggcuuccuggacguguggaccuacaacgccgagcugcucgugcugauggagaacgagcgcacccuggacuuccacgacagcaacgucaagaaccucuacgacaaggugcggcugcagcugcgcgacaacgccaaggagcucgggaacggcugcuucgaguucuaccacaagugcgacaacgagugcauggaguccguccggaacggcaccuacgacuacccgcaguacagcgaggaggcgcgccugaagcgggaggagaucuccggggugaagcuggagagcaucggcacguaccagauccucuccaucuacagcaccguggccuccagccuggcccuggccaucauggucgccgggcucucccuguggaugugcagcaacggcagccugcagugccgcaucugcaucuga

SEQ ID NO: 75034 - RNA, 1683 nt, Artificial Sequence
  derived and/or modified sequence opt1 from hemagglutinin__InfluenzaA__EPI470859
auggaggccaucccccugaucaccauccuccugguggucaccgccagcaacgcggacaagaucugcaucggcuaccaguccacgaacagcaccgagaccguggacacccugacggagaacaacgugccggucacccacgccaaggagcuccugcacaccgagcacaacgggaugcugugcgccaccaaccucggccgcccccugauccuggacacgugcaccaucgaggggcucaucuacggcaaccccuccugcgaccugcugcucgggggccgggaguggagcuacaucguggagcgccccuccgccgugaacggcaugugcuacccggggaacgucgagaaccuggaggagcugcggagcuucuucuccagcgccuccagcuaccagcgcauccagaucuuccccgacaccaucuggaacguguccuacagcggcaccuccaaggcgugcagcgacuccuucuaccggagcaugcgcuggcucacgcagaagaacaacgccuaccccauccaggacgcccaguacaccaacaaccgggggaaguccauccuguucauguggggcaucaaccacccgcccaccgacaccgcccagacgaaccuguacacccgcaccgacaccacgaccagcguggcgaccgaggacaucaaccggaccuucaagcccgucaucgggccccgcccccucgugaacggccugcagggccggaucgacuacuacugguccgugcugaagccggggcagacgcuccgcguccggagcaacggcaaccugaucgcccccugguacgggcacauccugagcggcgagucccacggccgcauccucaagaccgaccugaacagcggguccugcguggugcagugccagaccgagcggggcgggcugaacaccacgcuccccuuccacaacgucagcaaguacgccuucggcaacugccccaaguacgugggggugaagucccugaagcuggccgucggccuccgcaacgugccggcccggagcucccgcggccuguucggggcgaucgccggcuucaucgagggcggguggagcgggcugguggccggcugguacggcuuccagcacuccaacgaccagggggucggcaucgccgccgaccgggacagcacccagcgcgcgaucgacaagaucaccuccaaggugaacaacaucguggacaagaugaacaagcaguacgagaucaucgaccacgaguucagcgaggucgagaaccggcucaacaugaucaacaacaagaucgacgaccagauccaggacaucugggccuacaacgccgagcugcuggugcuccuggagaaccagaagacccuggacgagcacgacgccaacgucaacaaccucuacaacaaggugaagcgcgcccugggguccaacgcgauggaggacggcaaggggugcuucgagcuguaccacaagugcgacgaccagugcauggagacgauccgcaacggcaccuacaaccggcgcaaguacaaggaggagagccggcucgagcgccagaagaucgagggcgugaagcuggaguccgaggggaccuacaagauccugaccaucuacagcacggucgccuccagccucgugaucgccaugggcuucgccgccuuccuguucugggcgauguccaacgggagcugccggugcaacaucugcaucuga

SEQ ID NO: 75035 - RNA, 1683 nt, Artificial Sequence
  derived and/or modified sequence opt1 from hemagglutinin__InfluenzaA__EPI498037
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugcugcucgaggggcgcgaguggagcuacaucguggagcggcccuccgccgucaacggccugugcuaccccggcaacguggagaaccuggaggagcuccgcagccuguucuccagcgcccgguccuaccagcgcauccagaucuucccggacaccaucuggaacgugagcuacaacgggaccuccaaggccugcagcggcuccuucuaccggagcaugcgcuggcugacccggaagaacggggacuaccccauccaggacguccaguacaccaacaaccagggcaagaacauccucuucaugugggggaucaaccacccgcccaccgacacgacccagcgcgaccuguacacccggaccgacacgaccaccuccguggcgaccgaggagaucaaccgcaucuucaagccccugaucggcccccggccccucgugaacggccugauggggcgcaucgacuacuacuggagcguccugaagcccggccagacgcuccggaucaaguccgacgggaaccugaucgccccgugguacggccacauccugagcggcgagagccacgggcgcauccucaagaccgaccugaagcggggcuccugcaccgugcagugccagaccgagaagggcgggcugaacacgacccuccccuuccagaacgugagcaaguacgccuucgggaacugcuccaaguacaucggcaucaagagccugaagcuggccgucggccuccgcaacgugcccucccggagcucccgcgggcuguucggcgcgaucgccggguucaucgagggcggguggagcggccugguggccggcugguacggguuccagcacuccaacgaccagggcgucgggauggccgccgaccgggacagcacccagaaggcgaucgacaagaucaccuccaaggugaacaacaucguggacaagaugaacaagcaguacgagaucaucgaccacgaguucagcgaggucgagacgcgccucaacaugaucaacaacaagaucgacgaccagauccaggacaucugggccuacaacgccgagcugcuggugcuccuggagaaccagaagacccuggacgagcacgacgccaacgugaacaaccucuacaacaaggucaagcgggcccugggcuccaacgcgguggaggacgggaagggcugcuucgagcuguaccacaagugcgacaaccagugcauggagaccauccgcaacggcaccuacaacaagcgcaaguaccaggaggagagcaagcucgagcggcagaagaucgagggggucaagcuggaguccgagggcacguacaagauccugaccaucuacagcaccguggccuccagccucgugaucgccaugggguucgccgccuuccuguucugggcgauguccaacggcagcugccgcugcaacaucugcaucuga

SEQ ID NO: 75036 - RNA, 1683 nt, Artificial Sequence
  derived and/or modified sequence opt1 from hemagglutinin__InfluenzaA__AGO17847
auggagaccaucagccugaugaccauccuccugaucacgaccgccuccaacgccgacaagaucugcaucggccaccagagcaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuacggcaaccccagcugcgaccugcugcucgaggggcgcgagugguccuacaucguggagcggcccagcgccgucaacgggaccugcuaccccggcaacguggagaaccuggaggagcugcgcacccucuucuccagcgccuccagcuaccagcggauccagaucuucccggacaccacguggaacgugaccuacaccgggaccucccgcagcugcuccggcagcuucuaccgguccaugcgcuggcugacgcagaaguccggguucuaccccguccaggacgccaaguacaccaacaaccggggcaagaacauccuguucgugugggggauccaccacccccacaccuacaccgaccagacgacccucuacauccgcaacgacaccaccacgagcgugaccaccgaggagcugaaccggaucuucaagcccgucaucgugccgcgccugcucgugaacggccagcagggccggaucgacuacuacuggagcguccugaagcccgggcagacccugcgcgugcgguccaacggcaaccucaucgcgcccugguacgggcacgugcugagcggcggcagccacgggcgcauccugaagacggaccucaaguccggcaacugcgucgugcagugccagaccgagaagggcggccugaacagcacccugcccuuccacaacaucuccaaguacgccuucgggaccugcccgaaguacgugaaggucaacagccucaagcuggccaucggccugcggaacgugcccgcccgcuccaaccggggccucuucggggcgaucgccggcuucaucgagggcggguggcccgggcugguggccggcugguacggcuuccagcacagcaacgaccagggggucggcauggccgccgaccgcgacuccacgcagaaggcgguggacaagaucaccagcaaggugaacaacaucgucgacaagaugaacaagcaguacgagaucaucgaccacgaguucuccgagguggagacccggcugaacaugaucaacaacaagaucgacgaccagauccaggacgucugggccuacaacgccgagcuccuggugcugcucgagaaccagaagacccuggacgagcacgacgccaacgugaacaaccuguacaacaaggucaagcgcgcccucgggagcaacgcgauggaggacggcaaggggugcuucgagcuguaccacaagugcgacgaccagugcauggagaccauccggaacggcacguacgaccgccgcaaguaccgggaggagucccgccuggagcggcagcgcaucgagggcgugaagcucgagagcgaggggaccuacaagauccugaccaucuacuccaccguggccagcucccuggucaucgccaugggcuucgccgccuuccucuucugggcgaugagcaacggguccugccggugcaacaucugcaucuga

SEQ ID NO: 75037 - RNA, 1683 nt, Artificial Sequence
  derived and/or modified sequence opt1 from hemagglutinin__InfluenzaA__ANZ03807
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugagccuggaggggcgcgagugguccuacaucguggagcggcccagcgccgucaacggccucugcuaccccggcaacguggagaaccuggaggagcugcgcucccucuucagcuccgcccggagcuaccagcgcauccagaucuucccggacaccaucuggaacguguccuacgacgggaccagcaccgccugcuccggcagcuucuaccgguccaugcgcuggcugacccggaagaacggggacuaccccacccaggacgcgcaguacacgaacaaccagggcaagaacauccuguucaugugggggaucaaccacccgcccaccgacgacacccagcgcaaccucuacacccggacggacaccaccaccagcgucgccacggaggagaucaaccgcaucuucaagccccugaucggcccccggccccuggugaacggccucauggggcgcaucgacuacuacugguccgugcugaagcccggccagacccugcggaucaagagcgacgggaaccucaucgccccgugguacggccacauccugagcggcgagucccacgggcgcauccugaagaccgaccucaagcggggcagcugcaccguccagugccagacggagaagggcgggcugaacaccacccugcccuuccagaacguguccaaguacgccuucgggaacugcagcaaguacaucggcaucaagucccucaagcuggcggugggccugcgcaacguccccagccgguccagccgcggccucuucggggccaucgccggguucaucgagggcgggugguccggccugguggccggcugguacggguuccagcacagcaacgaccagggcguggggauggccgcggaccgggacuccacccagaaggccaucgacaagaucacgagcaaggucaacaacaucguggacaagaugaacaagcaguacgagaucaucgaccacgaguucuccgagguggagacccgccugaacaugaucaacaacaagaucgacgaccagauccaggacaucugggccuacaacgccgagcuccugguccugcucgagaaccagaagacccuggacgagcacgacgccaacgugaacaaccuguacaacaaggugaagcgggcgcucggcagcaacgccgucgaggacgggaagggcugcuucgagcuguaccacaagugcaacgaccagugcauggagaccauccgcaacggcacguacaaccgccggaaguaccaggaggaguccaagcuggagcgccagaagaucgagggggugaagcucgagagcgagggcaccuacaagauccugaccaucuacuccaccgucgccagcucccuggugaucgccaugggguucgccgcguuccucuucugggccaugagcaacggcagcugccggugcaacaucugcaucuga

SEQ ID NO: 75038 - RNA, 1683 nt, Artificial Sequence; identical to SEQ ID NO: 75037
  derived and/or modified sequence opt1 from hemagglutinin__InfluenzaA__EPI680526

SEQ ID NO: 75039 - RNA, 1683 nt, Artificial Sequence; identical to SEQ ID NO: 74693
  derived and/or modified sequence opt1 from hemagglutinin__InfluenzaA__ALT20080

SEQ ID NO: 75040 - RNA, 1410 nt, Artificial Sequence
  derived and/or modified sequence opt1 from neuraminidase__InfluenzaA__AAA43084
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgcgagcggccgggccgacacgcgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcggguacgugugcuccggccuggucggggacacgccccggaacgacgacagcuccagcaacuccaacugccgcgaccccaacaacgagcggggcaacccgggggugaagggcugggccuucgacaacggcgacgacguguggauggggcgcaccaucaacaaggagagccgguccggcuacgagaccuucaaggucaucgggggcuggagcacccccaacuccaagagccaggugaaccgccaggucaucguggacaacaacaacugguccggguacagcggcaucuucuccguggagggcaagagcugcaucaaccggugcuucuacgucgagcugauccgcgggcgcccccaggagacccgggugugguggaccagcaacuccaucguggucuucugcggcaccagcgggacguacggcaccggguccuggcccgacggcgccaacaucaacuucaugccgaucuga

SEQ ID NO: 75041 - RNA, 1362 nt, Artificial Sequence
  derived and/or modified sequence opt1 from neuraminidase__InfluenzaA__AAA43397
augaaccccaaccagaagaucaucaccaucggcagcaucugcaugguggucgggaucaucucccugauccuccagaucggcaacaucaucagcaucuggaucucccacagcauccagaccgggaaccagaaccacacgggcaucugcaaccagggguccaucaccuacaaggugguggccggccaggacagcaccuccgucauccugaccggcaacagcucccugugcccgauccgcgggugggccauccacagcaaggacaacggcauccggaucggguccaagggcgacguguucgugauccgcgagcccuucaucagcugcucccaccucgagugccggacguucuuccugacccagggggcgcugcucaacgacaagcacagccgcggcaccuucaaggaccggucccccuaccgcgcccugaugagcugccccgucggcgaggccccgucccccuacaacagccgguucgaguccguggccuggagcgccagcgcgugccacgacggggugggcuggcugaccaucgggaucuccggccccgacgacggcgccgucgccgugcucaaguacaaccgcaucaucacggagaccaucaagagcuggcggaagaacauccugcgcacccaggaguccgagugcacgugcgugaacgggagcugcuucaccaucaugaccgacggccccuccgacgggcuggccagcuacaagaucuucaagaucgagaagggcaaggucaccaaguccaucgagcucaacgcgccgaacagccacuacgaggagugcuccugcuaccccgacaccgggaaggugaugugcgugugccgggacaacuggcacggcagcaaccgccccugggucuccuucgaccagaaccuggacuacaagaucggcuacaucugcagcgggguguucggcgacaacccccggccgaaggacgggacgggcuccugcgggcccgugagcgccgacggcgccaacggcgucaagggguucuccuacaaguacggcaacgggguguggaucggccgcaccaagagcgacuccagccggcacggguucgagaugaucugggaccccaacggcuggaccgagaccgacucccgcuucagcaugcggcaggacguggucgccaucacgaaccgcagcggcuacuccgggagcuucgugcagcaccccgagcugaccggccucgacugcaugcggccgugcuucuggguggagcugauccgcgggcugcccgaggaggacgccaucuggaccuccggcagcaucaucuccuucugcggcgucaacagcgacaccguggacugguccuggcccgacggggcggagcuccccuucacgaucgacaaguga

SEQ ID NO: 75042 - RNA, 1365 nt, Artificial Sequence
  derived and/or modified sequence opt1 from neuraminidase__InfluenzaA__AAA43412
augaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacagcucccugugcccgauccgcggcugggccaucuacagcaaggacaacuccauccggaucggcagcaagggggacgucuucgugauccgcgagcccuucaucuccugcagccaccuggagugccggaccuucuuccucacccagggcgcccugcugaacgaccgccacuccaacgggacggugaaggaccggagccccuaccgcgcgcucauguccugccccgucggcgaggccccgagccccuacaacucccgguucgagagcguggccuggagcgccuccgccugccacgacgggaugggcuggcugaccaucggcaucagcgggcccgacaacggcgcgguggccguccugaaguacaacgggaucaucaccgagaccaucaaguccuggcgcaagaagauccuccggacgcaggagagcgagugcgccugcgugaacggcuccugcuucaccaucaugaccgacggccccagcgacgggcuggccuccuacaagaucuucaagaucgagaagggcaaggugaccaagagcaucgagcugaacgcgccgaacucccacuacgaggagugcagcugcuaccccgacacggggaaggucaugugcgugugccgcgacaacuggcacggcuccaaccggcccugggugagcuucgaccagaaccucgacuaccagaucggguacaucugcuccggcgucuucggcgacaacccccgcccgaaggacgggaccggcagcugcgggcccguguacguggacggcgccaacggggucaagggcuucuccuaccgguacggcaacgggguguggaucggccgcaccaagagccacuccagccggcacggguucgagaugaucugggaccccaacggcuggaccgagacggacuccaaguucagcgugcgccaggacgucguggccaugaccgacuggagcggguacuccggcagcuucgugcagcaccccgagcugaccggccuggacugcauccggccgugcuucugggucgagcucauccgcgggcggcccaaggagaagaccaucuggacguccgccagcuccaucagcuucugcggcgugaacuccgacaccgucgacuggagcuggcccgacggggccgagcugcccuucaccaucgacaaguga

SEQ ID NO: 75043 - RNA, 1410 nt, Artificial Sequence
  derived and/or modified sequence opt1 from neuraminidase__InfluenzaA__AAG01743
augaaccccaaccagaagaucaucacccugggcagcgugucccucaccaucgccacgaucugcuuccugaugcagaucgccauccuggucaccaccgugacccuccacuucaagcaguacgagugcgacuacccggcgaacaaccaggccaugcccugcgagcccaucaucaucgagcgcaacaucacggagaucguguaccugaccaacaccaccaucgagaaggaggucugccccaagcugguggaguaccggaacuggagcaagccgcagugcaagaucacgggguucgcccccuucuccaaggacaacagcauccgccucuccgccggcggggacaucugggugacccgggagcccuacgucagcugcgaccccggcaagugcuaccaguucgcccuggggcagggcaccacccuggacaacaagcacuccaacgacacgauccacgaccgcaccccgcaccggacccuccugaugaacgagcugggcgugcccuuccaccucgggacccgccaggugugcaucgcguggagcuccagcuccugccacgacggcaaggccuggcugcacgucugcgugacgggguacgacaagaacgccaccgccagcuucaucuacgacggccggcugguggacuccaucgggagcuggucccagaacauccuccgcacccaggagagcgagugcgucugcaucaacgggaccugcacgguggugaugaccgacggcuccgcgagcggccgggccgacaccaagauccuguucaucgaggagggcaagaucguccacaccagcccccuguccgggagcgcccagcacguggaggagugcuccugcuacccccgcuacccgggcgugcggugcaucugccgcgacaacuggaagggcagcaaccggcccgucguggacaucaacgugaaggacuacuccaucaacagcuccuacgucugcagcgggcucgugggcgacacgccccgcaacaacgaccgguccagcuccagcuacugccagaaccccaacaacgagaaggggacccacggcgugaaggggugggccuucgacgacggcaacgacgucuggaugggccgcaccaucuccgaggacagccgguccggguacgagaccuucaaggugaucggcggguggagcacgccgaacuccaagcugcagaucaaccgccaggucaucguggacagcgacaaccgguccggcuacagcgggaucuucuccguggagggcaagagcugcaucaaccgcugcuucuacgucgagcugauccggggccgcgagcaggagacccgcgugugguggaccagcaacuccaucguggucuucugcgggaccagcggcacguacgggaccggcuccuggcccgacggggccgacaucaacaucaugcccaucuga

SEQ ID NO: 75044 - RNA, 1410 nt, Artificial Sequence
  derived and/or modified sequence opt1 from neuraminidase__InfluenzaA__AAG01759
augaaccccaaccagaagaucaucaccaucggcagcgugucccugaccaucgccacgaugugcuuccucaugcagaucgccauccuggucaccaccgugacccugcacuucaagcaguacgagugcaacagcccgcccaacaaccaggugauccucugcgagcccacgaucaucgagcgcaacaucaccgagaucgucuaccugaccaacaccacgaucgagaaggagaucugccccaagcuggcggaguacaagaacugguccaagccgcagugcaagaucaccggguucgcccccuucagcaaggacaacuccauccggcucagcgccggcggggacaucugggugacccgcgagcccuacguguccugcgaccccgacaagugcuaccaguucgcccugggccaggggaccacgcugaacaaccggcacagcaacgacaccguccacgaccgcaccccguaccggacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcgccugguggacagcaucggcuccuggagcaagaagauccuccggacccaggaguccgagugcgucugcaucaacgggacgugcaccguggugaugaccgacggcagcgccuccggccgcgcggacaccaagauccuguucaucgaggaggggaagaucguccacaucagcccccugcucggcagcgcccagcacguggaggagugcuccugcuacccccgguacccgggggugcgcugcgucugccgggacaacuggaagggcagcaaccgccccaucguggacaucaacgugaaggacuacuccaucgucagcuccuacgugugcagcggccuggugggggacacgccccggaagaacgaccgcuccagcuccagcaacugccugaaccccaacaacgaggagggcgggcacggcgucaaggggugggccuucgacgacggcaacgacguguggaugggccggaccaucuccgagaagcuccgcagcggguacgagaccuucaaggucaucgagggcugguccaagccgaacagcaagcugcagaucaaccgccaggugaucguggaccgggggaaccgguccggcuacagcgggaucuucuccgucgagggcaagagcugcaucaaccgcugcuucuacguggagcugauccggggccgcaagcaggagaccgaggugugguggacguccaacagcaucgucguguucugcgggaccagcggcaccuacgggaccggcuccuggcccgacggggccgacaucaaccucaugcccaucuga

SEQ ID NO: 75045 - RNA, 1410 nt, Artificial Sequence
  derived and/or modified sequence opt1 from neuraminidase__InfluenzaA__AAG01777
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugauccucugcgagcccacgaucaucgagcgcaacaucaccgagaucgucuaccugaccaacaccacgaucgagaaggagaucugccccaagcuggcggaguacaagaacugguccaagccgcagugcaagaucaccggguucgcccccuucagcaaggacaacuccauccggcucagcgccggcggggacaucugggugacccgcgagcccuacguguccugcgaccccgacaagugcuaccaguucgcccugggccaggggaccacgcugaacaaccggcacagcaacgacaccguccacgaccgcaccccguaccggacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcgccugguggacagcaucggcuccuggagcaagaagauccuccggacccaggaguccgagugcgucugcaucaacgggacgugcaccguggugaugaccgacggcagcgccuccggccgcgcggacaccaagauccuguucaucgaggaggggaagaucguccacaucagcccccugcucggcagcgcccagcacguggaggagugcuccugcuacccccgguacccgggggugcgcugcgucugccgggacaacuggaagggcagcaaccgccccaucguggacaucaacgugaaggacuacuccaucgucagcuccuacgugugcagcggccuggugggggacacgccccggaagaacgaccgcuccagcuccagcaacugccugaaccccaacaacgaggagggcgggcacggcgucaaggggugggccuucgacgacggcaacgacguguggaugggccggaccaucuccgagaagcuccgcagcggguacgagaccuucaaggucaucgagggcugguccaagccgaacagcaagcugcagaucaaccggcccgugaucguggaccgcggggaccgguccggcuacagcgggaucuucuccgucgagggcaagagcugcaucaaccgcugcuucuacguggagcugauccggggccgcaagcaggagaccgaggugugguggacguccaacagcaucgucguguucugcgggaccagcggcaccuacgggaccggcuccuggcccgacggggccgacaucaaccucaugcccaucuga

SEQ ID NO: 75046 - RNA, 1410 nt, Artificial Sequence
  derived and/or modified sequence opt1 from neuraminidase__InfluenzaA__AAG01786
augaaccccaaccagaagaucaucaccaucggcagcgugucccugaccaucgccacgaugugcuuccucaugcagaucgccauccuggucaccaccgugacccugcacuucaagcaguacgagugcaacagcccgcccaacaaccaggugauccucugcgagcccacgaucaucgagcgcaacaucaccgagaucgucuaccugaccaacaccacgaucgagaaggagaucugccccaagcuggcggaguacaagaacugguccaagccgcagugcaagaucaccggguucgcccccuucagcaaggacaacuccauccggcucagcgccggcggggacaucugggugacccgcgagcccuacguguccugcgaccccgacaagugcuaccaguucgcccugggccaggggaccacgcugaacaaccggcacagcaacgacaccguccacgaccgcaccccguaccggacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcgccugguggacagcaucggcuccuggagcaagaagauccuccggacccaggaguccgagugcgucugcaucaacgggacgugcaccguggugaugaccgacggcagcgccuccggccgcgcggacaccaagauccuguucaucgaggaggggaagaucguccacaucagcccccugcucggcagcgcccagcacguggaggagugcuccugcuacccccgguacccgggggugcgcugcgucugccgggacaacuggaagggcagcaaccgccccaucguggacaucaacgugaaggacuacuccaucgucagcuccuacgugugcagcggccuggugggggacacgccccggaagaacgaccgcuccagcuccagcaacugccugaaccccaacaacgaggagggcgggcacggcgucaaggggugggccuucgacgacggcaacgacguguggaugggccggaccaucuccgagaagcuccgcagcggguacgagaccuucaaggucaucgagggcugguccaagccgaacagcaagcugcagaucaaccggcaggucaucguggaccgcggggaccgguccggcuacagcgggaucuucuccguggagggcaagagcugcaucaaccgcugcuucuacguggagcugauccggggccgcaagcaggagaccgaggugugguggacguccaacagcaucgucguguucugcgggaccagcggcaccuacgggaccggcuccuggcccgacggggccgacaucaaccucaugcccaucuga

SEQ ID NO: 75047 - RNA, 1410 nt, Artificial Sequence
  derived and/or modified sequence opt1 from neuraminidase__InfluenzaA__AAK71688
augaaccccaaccagaagaucaucaccaucggcagcgugucccugaccaucgccacgaugugcuuccucaugcagaucgccauccuggucaccaccgugacccugcacuucaagcaguacgagugcaacagcccgcccaacaaccaggugauccucugcgagcccacgaucaucgagcgcaacaucaccgagaucgucuaccugaccaacgcgaccaucgagaaggagaucugccccaagcuggccgaguaccggaacugguccaagccgcagugcaagaucacgggguucgcccccuucagcaaggacaacuccauccgccucagcgccggcggggacaucugggugacccgggagcccuacguguccugcgaccccgacaagugcuaccaguucgcccugggccaggggaccacccugaacaaccgccacagcaacgacacgguccacgaccggaccccguaccgcacccuccugaugaacgagcugggcgugcccuuccaccucggcaccaagcaggucugcaucgcgugguccagcuccagcugccacgacgggaaggccuggcugcacgugugcgugacgggccacgacgagaacgccaccgccuccuucaucuacgacgggcggcugguggacagcaucggcuccuggagcaagaagauccuccgcacccaggaguccgagugcgucugcaucaacgggaccugcacgguggugaugaccgacggcagcgcguccggccgggccgacaccaagauccuguucaucgaggaggggaagaucguccacaucagcccccugcucggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccuggugggggacacgccccgcaagaacgaccgguccagcuccagcaacugccugaaccccaacaacgaggagggcgggcacggcgucaaggggugggccuucgacgacggcaacgacguguggaugggccgcaccaucuccgaggagcuccggagcggguacgagaccuucaaggucaucgagggcugguccaagccgaacagcaagcugcagaucaaccgccaggugaucguggaccgcggggaccgguccggcuacagcgggaucuucuccgucgagggcaagagcugcaucaaccggugcuucuacguggagcugauccgcggccgcaagcaggagaccgaggugugguggaccuccaacagcaucgucguguucugcgggacgagcggcaccuacgggaccggcuccuggcccgacggggccgacaucaaccucaugcccaucuga

SEQ ID NO: 75048 - RNA, 1410 nt, Artificial Sequence
  derived and/or modified sequence opt1 from neuraminidase__InfluenzaA__AAN01169
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggccgggcggacaccaagauccuguucaucgaggaggggaagaucauccacaucagccagcucagcggcuccgcccagcacgucgaggagugcagcugcuacccccgcuaccccggggugcggugcgugugccgcgacaacuggaagggcuccaaccggcccaucgucgacaucaacgugaaggacuacagcaucguguccagcuacgucugcuccggccuggugggggacacgccgcgcaagaacgacagcuccagcuccagccacugccugaaccccaacaacgaggagggcgggcacggcgugaaggggugggccuucgacgacggcaacgacgucuggaugggccggaccaucuccgagaaguuccgcagcggguacgagaccuucaaggugaucgagggcugguccaagcccaacagcaagcuccagaucaaccggcaggucaucguggaccgcgacaaccgguccggguacagcggcaucuucuccguggagggcaagagcugcaucaaccgcugcuucuacgucgagcugauccgggggcgcaagcaggagaccgaggugugguggacgagcaacuccaucguggucuucugcggcaccagcgggaccuacggcaccggguccuggcccgacggcgccgacaucaaccugaugccgaucuga

SEQ ID NO: 75049 - RNA, 1410 nt, Artificial Sequence; identical to SEQ ID NO: 75048
  derived and/or modified sequence opt1 from neuraminidase__InfluenzaA__AAN01170

SEQ ID NO: 75050 - RNA, 1410 nt, Artificial Sequence
  derived and/or modified sequence opt1 from neuraminidase__InfluenzaA__AAN01171
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacggccggacccccuaccgcacccugcugaugaacgagcucggcgugccguuccaccuggggacgaagcaggucugcaucgccugguccagcuccagcugccacgacggcaaggcguggcugcacgugugcgugaccgggcacgacgagaacgccaccgccuccuucaucuacgacggccggcucguggacagcaucggguccuggagcaagaagauccugcgcacccaggaguccgagugcgucugcaucaacggcacgugcaccguggugaugaccgacggcagcgccuccgggcgggcggacaccaagauccuguucaucgaggagggcaagaucauccacaucagccagcucagcggguccgcccagcacgucgaggagugcagcugcuacccccgcuaccccggcgugcggugcgugugccgcgacaacuggaagggcuccaaccggcccaucgucgacaucaacgugaaggacuacagcaucguguccagcuacgucugcuccgggcuggugggcgacacgccgcgcaagaacgacagcuccagcuccagccacugccugaaccccaacaacgaggagggcgggcacggggugaagggcugggccuucgacgacggcaacgacgucuggauggggcggaccaucuccgagaaguuccgcagcggcuacgagaccuucaaggugaucgaggggugguccaagcccaacagcaagcuccagaucaaccggcaggucaucguggaccgcgacaaccgguccggcuacagcgggaucuucuccguggagggcaagagcugcaucaaccgcugcuucuacgucgagcugauccggggccgcaagcaggagaccgaggugugguggacgagcaacuccaucguggucuucugcgggaccagcggcaccuacgggaccggcuccuggcccgacggggccgacaucaaccugaugccgaucuga

SEQ ID NO: 75051 - RNA, 1410 nt, Artificial Sequence; identical to SEQ ID NO: 75048
  derived and/or modified sequence opt1 from neuraminidase__InfluenzaA__AAN01172

SEQ ID NO: 75052 - RNA, 1410 nt, Artificial Sequence
  derived and/or modified sequence opt1 from neuraminidase__InfluenzaA__AAN01173
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaugugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggccgggcggacaccaagauccuguucaucgaggaggggaagaucauccacaucagccagcucagcggcuccgcccagcacgucgaggagugcagcugcuacccccgcuaccccggggugcggugcgugugccgcgacaacuggaagggcuccaaccggcccaucgucgacaucaacgugaaggacuacagcaucguguccagcuacgucugcuccggccuggugggggacacgccgcgcaagaacgacagcuccagcuccagccacugccugaaccccaacaacgaggagggcgggcacggcgugaaggggugggccuucgacgacggcaacgacgucuggaugggccggaccaucuccgagaaguuccgcagcggguacgagaccuucaaggugaucgagggcugguccaagcccaacagcaagcuccagaucaaccggcaggucaucguggaccgcgacaaccgguccggguacagcggcaucuucuccguggagggcaagagcugcaucaaccgcugcuucuacgucgagcugauccgggggcgcaagcaggagaccgaggugugguggacgagcaacuccaucguggucuucugcggcaccagcgggaccuacggcaccggguccuggcccgacggcgccgacaucaaccugaugccgaucuga

SEQ ID NO: 75053 - RNA, 1410 nt, Artificial Sequence; identical to SEQ ID NO: 75048
  derived and/or modified sequence opt1 from neuraminidase__InfluenzaA__AAN01174

SEQ ID NO: 75054 - RNA, 1410 nt, Artificial Sequence; identical to SEQ ID NO: 75048
  derived and/or modified sequence opt1 from neuraminidase__InfluenzaA__AAN01175

SEQ ID NO: 75055 - RNA, 1410 nt, Artificial Sequence; identical to SEQ ID NO: 75048
  derived and/or modified sequence opt1 from neuraminidase__InfluenzaA__AAN01176

SEQ ID NO: 75056 - RNA, 1410 nt, Artificial Sequence; identical to SEQ ID NO: 75048
  derived and/or modified sequence opt1 from neuraminidase__InfluenzaA__AAN01177

SEQ ID NO: 75057 - RNA, 1410 nt, Artificial Sequence; identical to SEQ ID NO: 75048
  derived and/or modified sequence opt1 from neuraminidase__InfluenzaA__AAN01178

SEQ ID NO: 75058 - RNA, 1410 nt, Artificial Sequence; identical to SEQ ID NO: 75048
  derived and/or modified sequence opt1 from neuraminidase__InfluenzaA__AAN01179

SEQ ID NO: 75059 - RNA, 1410 nt, Artificial Sequence; identical to SEQ ID NO: 75048
  derived and/or modified sequence opt1 from neuraminidase__InfluenzaA__AAN01180

SEQ ID NO: 75060 - RNA, 1410 nt, Artificial Sequence
  derived and/or modified sequence opt1 from neuraminidase__InfluenzaA__AAN01181
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggccgggcggacaccaagauccuguucaucgaggaggggaagaucauccacaucagccagcucagcggcuccgcccagcacgucgaggagugcagcugcuacccccgcuaccccggggugcggugcgugugccgcgacaacuggaagggcuccaaccggcccaucgucgacaucaacgugaaggacuacagcaucguguccagcuacgucugcuccggccuggugggggacacgccgcgcaagaacgacagcuccagcuccagccacugccugaaccccaacaacgaggagggcgggcacggcgugaaggggugggccuucgacgacggcaacgacgucuggaugggccggaccaucggggagaaguuccgcuccggcuacgagaccuucaaggugaucgagggguggagcaagcccaacuccaagcuccagaucaaccggcaggucaucguggaccgcgacaaccggagcggcuacuccgggaucuucagcguggagggcaaguccugcaucaaccgcugcuucuacgucgagcugauccggggccgcaagcaggagaccgaggugugguggacgagcaacagcaucguggucuucugcgggaccuccggcaccuacgggaccggcagcuggcccgacggggccgacaucaaccugaugccgaucuga

SEQ ID NO: 75061 - RNA, 1410 nt, Artificial Sequence; identical to SEQ ID NO: 75048
  derived and/or modified sequence opt1 from neuraminidase__InfluenzaA__AAN01182

SEQ ID NO: 75062 - RNA, 1410 nt, Artificial Sequence; identical to SEQ ID NO: 75048
  derived and/or modified sequence opt1 from neuraminidase__InfluenzaA__AAN01183

SEQ ID NO: 75063 - RNA, 1410 nt, Artificial Sequence; identical to SEQ ID NO: 75048
  derived and/or modified sequence opt1 from neuraminidase__InfluenzaA__AAN01184

SEQ ID NO: 75064 - RNA, 1410 nt, Artificial Sequence; identical to SEQ ID NO: 75048
  derived and/or modified sequence opt1 from neuraminidase__InfluenzaA__AAN01185

SEQ ID NO: 75065 - RNA, 1410 nt, Artificial Sequence
  derived and/or modified sequence opt1 from neuraminidase__InfluenzaA__AAN01186
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggccgggcggacaccaagauccuguucaucgaggaggggaagaucauccacaucagccagcucagcggcuccgcccagcacgucgaggagugcagcugcuacccccgcuaccccggggugcggugcgugugccgcgacaacuggaagggcuccaaccggcccaucgucgacaucaacgugaaggacuacagcaucguguccagcuacgucugcuccggccuggugggggacacgccgcgcaagaacgacagcuccagcuccagccacugccugaaccccaacaacgaggagggcgggcacggcgugaaggggugggccuucgacgacggcaacgacgucuggaugggccggaccaucuccgagaaguuccgccucggguacgagaccuucaaggugaucgagggcuggagcaaguccaacagcaagcugcagaucaaccggcaggucaucguggaccgcgacaaccgguccggguacagcggcaucuucuccguggagggcaagagcugcaucaaccgcugcuucuacgucgagcugauccgggggcgcaagcaggagaccgaggugugguggacgagcaacuccaucguggucuucugcggcaccagcgggaccuacggcaccggguccuggcccgacggcgccgacaucaaccucaugcccaucuga

SEQ ID NO: 75066 - RNA, 1410 nt, Artificial Sequence
  derived and/or modified sequence opt1 from neuraminidase__InfluenzaA__AAN01187
augaaccccaaccagaagaucaucaccaucggcagcgugucccugaccaucgccacgaucugcuuccucaugcagaucgccauccuggucaccaccgugacccugcacuucaagcaguacgagugcgacagccucccgaacaaccaggugaugcugugcgagcccacgaucaucgagcgcaacaucaccgagaucgucuaccugaccaacaccacgaucgagaaggagaugugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggccgggcggacaccaagauccuguucaucgaggaggggaagaucauccacaucagccagaugagcggcuccgcccagcacgucgaggagugcagcugcuacccccgcuaccccggggugcggugcgugugccgcgacaacuggaagggcuccaaccggcccaucgucgacaucaacgugaaggacuacagcaucguguccagcuacgucugcuccggccucgugggggacacgccgcgcaagaacgacagcuccagcuccagccacugccugaaccccaacaacgaggagggcgggcacggcgugaaggggugggccuucgacgacggcaacgacgucuggaugggccggaccaucuccgagaaguuccgcagcggguacgagaccuucaaggugaucgagggcugguccaagcccaacagcaagcugcagaucaaccggcaggucaucguggaccgcgacaaccgguccggguacagcggcaucuucuccguggagggcaagagcugcaucaaccgcugcuucuacgucgagcucauccgggggcgcaagcaggagaccgaggugugguggacgagcaacuccaucguggucuucugcggcaccagcgggaccuacggcaccggguccuggcccgacggcgccgacaucaaccugaugccgaucuga

SEQ ID NO: 75067 - RNA, 1410 nt, Artificial Sequence; identical to SEQ ID NO: 75048
  derived and/or modified sequence opt1 from neuraminidase__InfluenzaA__AAN01188

SEQ ID NO: 75068 - RNA, 1410 nt, Artificial Sequence
  derived and/or modified sequence opt1 from neuraminidase__InfluenzaA__AAN64883
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcgacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcaccagcgggaccuacggcacgggguccuggccggacggcgccgacaucaaccugaugcccaucuga

SEQ ID NO: 75069 - RNA, 1410 nt, Artificial Sequence
  derived and/or modified sequence opt1 from neuraminidase__InfluenzaA__AAN64884
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcaccagcgggaccuacggcacgggguccuggccggacggcgccgacaucaaccugaugcccaucuga

SEQ ID NO: 75070 - RNA, 1410 nt, Artificial Sequence; identical to SEQ ID NO: 75069
  derived and/or modified sequence opt1 from neuraminidase__InfluenzaA__AAN64885

SEQ ID NO: 75071 - RNA, 1410 nt, Artificial Sequence; identical to SEQ ID NO: 75069
  derived and/or modified sequence opt1 from neuraminidase__InfluenzaA__AAN64886

SEQ ID NO: 75072 - RNA, 1410 nt, Artificial Sequence; identical to SEQ ID NO: 75069
  derived and/or modified sequence opt1 from neuraminidase__InfluenzaA__AAN64887

SEQ ID NO: 75073 - RNA, 1410 nt, Artificial Sequence
  derived and/or modified sequence opt1 from neuraminidase__InfluenzaA__AAN64888
augaaccccaaccagaagaucaucaccaucggcagcgugucccugaccaucgccacgaucugcuuccucaugcagaucgucauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccagcuccagcugccacgacggcaaggccuggcugcacgugugcgugaccggggacgacaagaacgcgaccgccuccuucaucuacaacggccgccuggucgacagcaucggguccuggagcaagaagauccuccggacccaggaguccgagugcgugugcaucaacggcacgugcaccguggucaugaccgacggcagcgccuccgggaaggccgacaccaagauccuguucaucgaggagggcaagaucgugcacacgagccugcucagcggguccgcgcagcacguggaggagugcagcugcuacccccgcuaccccggcguccggugcgugugccgcgacaacuggaagggcuccaaccggccgaucguggacaucaacgucaaggacuacagcaucguguccagcuacgugugcuccgggcuggucggcgacacgccccgcaagaacgacagcuccagcuccagccacugccuggaccccaacaacgaggagggcgggcacggggugaagggcugggccuucgacgacggcaacgacgucuggauggggcggaccaucuccgagaagcuccgcagcggcuacgagaccuucaaggugaucgaggggugguccaagcccaacagcaagcugcagaucaaccgccaggugaucgucgaccggggcaaccgguccggguacagcggcaucuucuccguggagggcaagagcugcaucaaccgcugcuucuacguggagcugauccgggggcgcaaccaggagaccgagguccucuggaccagcaacuccaucgugguguucugcggcaccagcgggaccuacggcacgggguccuggccggacggcgccgacaucaaccugaugcccaucuga

SEQ ID NO: 75074 - RNA, 1410 nt, Artificial Sequence; identical to SEQ ID NO: 75069
  derived and/or modified sequence opt1 from neuraminidase__InfluenzaA__AAN64889

SEQ ID NO: 75075 - RNA, 1410 nt, Artificial Sequence
  derived and/or modified sequence opt1 from neuraminidase__InfluenzaA__AAN64890
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggagaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggucacccgggagcccuacguguccugcgaccccgacaagugcuaccaguucgcccugggccaggggaccacgcugaacaacggccacagcaacgacaccgugcacgaccgcaccccguaccggacccuccugaugaacgagcugggcguccccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgugugcaucaacggcacgugcaccgucgugaugaccgacggcagcgccuccgggaaggcggacaccaagauccuguucaucgaggagggcaagaucgugcacacgagccugcucagcggguccgcccagcacgucgaggagugcagcugcuacccccgcuaccccggcgugcggugcgugugccgcgacaacuggaagggcuccaaccggccgaucgucgacaucaacgugaaggacuacagcaucguguccagcuacgucugcuccgggcuggugggcgacacgccccgcaagaacgacagcuccagcuccagccacugccuggaccccaacaacgaggagggcgggcacggggugaagggcugggccuucgacgacggcaacgacgucuggauggggcggaccaucuccgagaagcuccgcagcggcuacgagaccuucaaggugaucgaggggugguccaagcccaacagcaagcugcagaucaaccggcaggucaucguggaccgcggcaaccgguccggguacagcggcaucuucuccguggagggcaagagcugcaucaaccgcugcuucuacgucgagcugauccgggggcgcaagcaggagaccgaggugcucuggaccagcaacuccaucguggucuucugcggcaccagcgggaccuacggcacgggguccuggccggacggcgccgacaucaaccugaugcccaucuga

SEQ ID NO: 75076 - RNA, 1410 nt, Artificial Sequence; identical to SEQ ID NO: 75069
  derived and/or modified sequence opt1 from neuraminidase__InfluenzaA__AAN64891

SEQ ID NO: 75077 - RNA, 1410 nt, Artificial Sequence
  derived and/or modified sequence opt1 from neuraminidase__InfluenzaA__AAO46212
augaaccccaaccagaagaucaucaccaucggcagcgugucccugaccaucgagacggucugcuuccucaugcagaucgccauccuggccaccaccgugacccugcacuucaagcagcacgagugcgacagcccggcguccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgacaccggcaagugcuaccaguucgcccuggggcagggcaccacccucgacaacaagcacuccaacggcacgauccacgaccgcaucccccaccggacccugcugaugaacgagcucggggugccguuccaccugggcaccaagcaggucugcguggccuggagcuccagcuccugccacgacgggaaggcguggcugcacgugugcgucaccggcgacgaccgcaacgccacggccagcuucaucuacgacgggcggcucguggacuccaucggcagcuggucccagaacauccugcgcacccaggagagcgagugcgugugcaucaacgggaccugcaccgucgugaugacggacggcuccgccagcggccgggcggacacccgcauccuguucaucaaggaggggaagaucgugcacaucagcccccucuccggcagcgcccagcacaucgaggagugcuccugcuacccccgguaccccgacguccgcugcaucugccgggacaacuggaagggcagcaaccgcccggugaucgacaucaacauggaggacuacuccaucgacagcuccuacgugugcagcgggcuggucggcgacacgccccggaacgacgacuccagcuccaacagcaacugccgcgaccccaacaacgagcgggggaaccccggcgugaaggggugggccuucgacaacggcgacgacguguggaugggccgcaccaucuccaaggaccugcggagcggguacgagaccuucaaggucaucggcgggugguccaccccgaacagcaagucccaggugaaccgccaggucaucguggacaacaacaacuggagcggcuacuccgggaucuucagcguggagggcaagagcugcaucaaccggugcuucuacgucgagcucauccgcggccgcccccaggagacccgggugugguggaccuccaacagcaucguggucuucugcgggacguccggcaccuacgggaccggcagcuggcccgacggggccaacaucaacuucaugcccaucuga

SEQ ID NO: 75078 - RNA, 1410 nt, Artificial Sequence
  derived and/or modified sequence opt1 from neuraminidase__InfluenzaA__AAO46213
augaaccccaaccagaagaucaucaccaucgacagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggcuucgcccccuucuccaaggacaacagcauccgccuguccgccgggggcgacaucugggucacgcgggagcccuacgugagcugcgacaccgggaagugcuaccaguucgcccugggccaggggaccacccucgacaacaagcacuccaacggcacgauccacgaccgcaucccccaccggacccugcugaugaacgagcucggcgugccguuccaccuggggaccaagcaggucugcguggcguggagcuccagcuccugccacgacggcaaggccuggcugcacgugugcgucaccggggacgaccgcaacgccacggccagcuucaucuacgacggccggcucguggacuccaucgggagcuggucccagaacauccugcgcacccaggagagcgagugcgugugcaucaacgggaccugcaccgucgugaugacggacggcuccgcgagcgggcgggccgacacccgcauccuguucaucaaggagggcaagaucgugcacaucagcccccucuccgggagcgcccagcacaucgaggagugcuccugcuacccccgguaccccgacguccgcugcaucugccgggacaacuggaagggcagcaaccgcccggugaucgacaucaacauggaggacuacuccaucgacagcuccuacgugugcagcggccuggucggggacacgccccggaacgacgacuccagcuccaacagcaacugccgcgaccccaacaacgagcggggcaaccccggggugaagggcugggccuucgacaacggggacgacguguggaugggccgcaccaucuccaaggaccugcggagcggcuacgagaccuucaaggucaucgggggcugguccaccccgaacagcaagucccaggugaaccgccaggucaucguggacaacaacaacuggagcggguacuccggcaucuucagcguggagggcaagagcugcaucaaccggugcuucuacgucgagcucauccgcggccgcccccaggagacccgggugugguggaccuccaacagcaucguggucuucugcggcacguccgggaccuacggcaccgggagcuggcccgacggcgccaacaucaacuucaugcccaucuga

SEQ ID NO: 75079 - RNA, 1410 nt, Artificial Sequence
  derived and/or modified sequence opt1 from neuraminidase__InfluenzaA__AAO46214
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggccguggaguaccggaacuggagcaagccgcagugccagaucaccggguucgcccccuucuccaaggacaacagcauccgccuguccgccggcggggacaucugggugacgcgggagcccuacgucagcugcgaccccggcaagugcuaccaguucgcgcuggggcagggcaccacccucgacaacaagcacuccaacggcaccauccacgaccgcaucccgcaccggacgcugcugaugaacgagcucggggugcccuuccaccugggcaccaagcaggucugcguggccuggagcuccagcuccugccacgacgggaaggccuggcugcacgugugcgugaccggcgacgaccgcaacgccaccgcgagcuucaucuacgacgggcggcucgucgacuccaucggcagcuggucccagaacauccugcgcacgcaggagagcgagugcgugugcaucaacggcaucugcaccguggucaugaccgacggguccgccagcggccgggccgacacccgcauccuguucaucgaggaggggaagaucgugcacaucagcccccucuccggcagcgcccagcacguggaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgaccgcuccagcaacuccaacugccgggaccccaacaacgagcgcgggaacccgggcgugaaggggugggccuucgacaacggcgacgacguguggaugggccggaccaucagcaaggaccugcgcuccggguacgagaccuucaaggucaucggcggguggagcacccccaacuccaagagccaggugaaccggcaggucaucguggacaacaacaacugguccggcuacagcgggaucuucuccguggagggcaagagcugcaucaaccgcugcuucuacgucgagcucauccgcggccggcagcaggagacgcgcgugugguggaccagcaacuccaucguggucuucugcgggaccagcggcaccuacgggacgggcuccuggcccgacggggcgaacaucaacuucaugcccaucuga

SEQ ID NO: 75080 - RNA, 1410 nt, Artificial Sequence
  derived and/or modified sequence opt1 from neuraminidase__InfluenzaA__AAO46215
augaaccccaaccagaagaucaucaccaucggcagcgugucccugaccaucgccacggucugcuuccucaugcagaucgccauccuggcgaccaccgugacccugcacuucaagcagcacgagugcgacagcccgacguccaaccaggugaugcccugcgagcccaucaucaucgagcgcaacaucaccgagaucgucuaccucaacaacaccaccaucgagaaggagaucugccccgaggugguggaguaccggaacuggagcaagccgcagugccagaucacgggguucgcccccuucuccaaggacaacagcauccgccuguccgccggcggggacaucugggucacccgggagcccuacgugagcugcgaccccggcaagugcuaccaguucgcccuggggcagggcaccacccucgacaacaagcacuccaacggcacgauccacgaccgcaucccgcaccggacccugcugaugaacgagcucggggugcccuuccaccugggcaccaagcaggucugcguggccuggagcuccagcuccugccacgacgggaaggcguggcugcacgugugcgucaccggcgacgaccgcaacgccacggccagcuucaucuacgacgggcggcucguggacuccaucggcagcuggucccagaacauccugcgcacccaggagagcgagugcgugugcaucaacgggaccugcaccgucgugaugacggacggcuccgccagcggccgggcggacacccgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacggggacuccagcuccaacagcaacugccgcgaccccaacaacgagcggggcaacccgggggugaagggcugggccuucgacaacggcgacgacguguggauggggcgcaccaucuccaaggagagccgguccggcuacgagaccuucaaggucaucgggggcuggagcacccccaacuccaagagccaggugaaccgccaggucaucguggacaacaacaacugguccggguacagcggcaucuucagcguggagggcaaguccugcaucaaccggugcuucuacgucgagcugauccgcgggcgcccccaggagacccgggugugguggaccagcaacuccaucguggucuucugcggcacgagcgggaccuacggcaccggguccuggcccgacggcgccaacaucaacuucaugccgaucuga

SEQ ID NO: 75081 - RNA, 1410 nt, Artificial Sequence
  derived and/or modified sequence opt1 from neuraminidase__InfluenzaA__AAO46216
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccuccaagugcuaccaguucgcccugggccaggggaccacccucgagaacaagcacagcaacggcaccaagcacgaccgcaucccgcaccggacgcugcugaugaacgagcucggcgugcccuuccaccuggggaccaagcaggucugcguggcgugguccagcuccagcugccacgacggcaaggccuggcugcacgugugcgucaccggggacgaccgcaacgccaccgccuccuucaucuacgagggccggcucguggacagcaucguguccuggagccagaacauccugcgcacgcaggaguccgagugcgucugcaucaacgggaccugcaccguggugaugaccgacggcagcgcgagcggccgggccgacacgcgcauccuguucaucaaggaggggaagaucguccacaucagcccccucuccggcuccgcccagcacaucgaggagugcagcugcuacccccgguacccggacgugcgcugcaucugccgggacaacuggaagggguccaaccgccccgugaucgacaucaacauggaggacuacagcaucgacuccagcuacgucugcuccggccuggugggcgacacgccccggaacgacgacagcuccagcaacuccaacugccgcgaccccaacaacgagcgggggaacccgggcgugaaggggugggccuucgacaacggcgacgacgucuggauggggcgcaccaucagcaaggacucccggagcggcuacgagaccuucaaggugaucggcgggugguccacccccaacagcaagucccaggucaaccgccaggugaucguggacagcaacaacuggagcggcuacuccgggaucuucagcgucgagggcaaguccugcaucaaccggugcuucuacguggagcugauccgcgggcgcccccaggagacccgggugugguggaccagcaacuccaucgucguguucugcggcaccagcggcacguacgggaccggcuccuggcccgacggggccaacaucaacuucaugccgaucuga

SEQ ID NO: 75082 - RNA, 1410 nt, Artificial Sequence
  derived and/or modified sequence opt1 from neuraminidase__InfluenzaA__AAO46217
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccuccaagugcuaccaguucgcccugggccaggggaccacccucgacaacaagcacagcaacggcaccauccacgaccgcaucccgcaccggacgcugcugaugaacgagcucggcgugcccuuccaccuggggaccaagcaggucugcguggcgugguccagcuccagcugccacgacggcaaggccuggcugcacgugugcgucaccggggacgaccgcaacgccaccgccuccuucaucuacgacggccggcucgaggacagcaucggguccuggagccagaacauccugcgcacgcaggaguccgagugcgugugcaucaacgggaccugcaccguggucaugaccgacggcagcgcgagcgggcgggccgacacgcgcauccuguucaucaaggagggcaagaucgugcacaucagcccccucuccggguccgcccagcacaucgaggagugcagcugcuacccccgguacccggacgugcgcugcaucugccgggacaacuggaagggcuccaaccgccccguccuggacaucagcauggaggacuacuccaucgacagcuccuacgugugcagcggccuggugggggacacgccccggaacgacgacuccagcuccaacagcaacugccgcgaccccaacaacgagcggggcaacccgggggucaagggcugggccuucgacaacggggacgacguguggaugggccgcaccaucuccaaggaccuccggagcggcuacgagaccuucaaggugaucgggggcugguccacccccaacagcaagucccaggucaaccgccaggugaucgucgacaacaacaacuggagcggguacagcggcaucuucuccguggagggcaagagcugcaucaaccggugcuucuacguggagcugauccgcggccgcucccaggagacccgggucugguggaccagcaacuccaucgugguguucugcggcaccagcgggacguacggcaccggguccuggcccgacggcgccaacaucaacuucaugcccaucuga

SEQ ID NO: 75083 - RNA, 1410 nt, Artificial Sequence
  derived and/or modified sequence opt1 from neuraminidase__InfluenzaA__AAO46218
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucgaggacuccaucggcagcuggucccagaacauccugcgcacgcaggagagcgagugcgugugcaucaacgggaccugcaccguggucaugaccgacggcuccgcgagcggccgggccgacacgcgcauccuguucaucaaggaggggaagaucgugcacaucagcccccucuccggcagcgcccagcacaucgaggagugcuccugcuacccccgguacccggacgugcgcugcaucugccgggacaacuggaagggcagcaaccgccccguccuggacaucuccauggaggacuacagcaucggguccagcuacgugugcuccggccuggugggggacacgccccggaacgacgacagcuccagcaacuccaacugccgcgaccccaacaacgagcggggcaacccgggggucaagggcugggccuucgacaacggcgacgacguguggauggggcgcaccaucagcaaggaccuccgguccggcuacgagaccuucaaggugaucgggggcuggagcacccccaacuccaagagccaggucaaccgccaggugaucgucgacaacaacaacugguccggguacagcggcaucuucagcguggagggcaaguccugcaucaaccggugcuucuacguggagcugauccgcgggcgcagccaggagacccgggucugguggaccuccaacagcaucgugguguucugcggcaccuccgggacguacggcaccgggagcuggcccgacggcgccaacaucaacuucaugcccaucuga

SEQ ID NO: 75084 - RNA, 1410 nt, Artificial Sequence
  derived and/or modified sequence opt1 from neuraminidase__InfluenzaA__AAO46220
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggccguggaguaccggaacuggagcaagccgcagugccagaucaccggguucgcccccuucuccaaggacaacagcauccgccuguccgccggcggggacaucugggugacgcgggagcccuacgucagcugcgaccccggcaagugcuaccaguucgcgcuggggcagggcaccacccucgacaacaagcacuccaacgacaccauccacgaccgcaucccgcaccggacgcugcugaugaacgagcucggcgugcccuuccaccuggggacccgccaggugugcgucgccuggagcuccagcuccugccacgacggcaaggccuggcugcacgugugcgugaccggggacgaccggaacgccaccgcgagcuucaucuacgacggccgccucgucgacuccaucgggagcuggucccagaacauccugcggacgcaggagagcgagugcgugugcaucaacggcaucugcaccguggucaugaccgacggcuccgccagcgggcgcgccgacacccggauccuguucaucgaggagggcaagaucgugcacaucagcccccucuccgggagcgcccagcacguggaggagugcuccugcuacccccgcuacccggacguccggugcaucugccgcgacaacuggaagggcagcaaccggcccgugaucgacaucaacauggaggacuacuccaucgacagcuccuacgugugcagcggccuggucggggacacgccccgcaacgacgaccgguccagcaacuccaacugccgcgaccccaacaacgagcggggcaacccgggggugaagggcugggccuucgacaacggggacgacguguggaugggccgcaccaucagcaaggaccugcgguccggcuacgagaccuucaaggucaucgggggcuggagcacccccaacuccaagagccaggugaaccgccaggucaucguggacaacaacaacugguccggguacagcggcaucuucuccguggagggcaagagcugcaucaaccgcugcuucuacgucgagcucauccgggggcgccagcaggagacgcgggugugguggaccagcaacuccaucguggucuucugcggcaccagcgggaccuacggcacgggguccuggcccgacggcgcgaacaucaacuucaugcccaucuga

SEQ ID NO: 75085 - RNA, 1410 nt, Artificial Sequence
  derived and/or modified sequence opt1 from neuraminidase__InfluenzaA__AAO46221
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggccgccgaguaccggaacuggagcaagccgcagugccagaucaccggguucgcccccuucuccaaggacaacagcauccgccuguccgcgggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggagcuccagcuccugccacgacggcaaggccuggcugcacgucugcgugaccggggacgaccggaacgcgaccgccagcuucaucuacgacggccgccucguggacuccaucgggagcuggucccagaacauccugcggacgcaggagagcgagugcgucugcaucaacggcaucugcaccguggugaugaccgacggcuccgccagcgggcgcgccgacacccggauccuguucaucgaggagggcaagaucguccacaucagcccccucuccgggagcgcccagcacguggaggagugcuccugcuacccccgcuacccggacgugcggugcaucugccgcgacaacuggaagggcagcaaccggcccgucaucgacaucaacauggaggacuacuccaucgacagcuccuacgugugcagcggccuggugggggacacgccccgcaacgacgaccgguccagcaacuccaacugccgcgaccccaacaacgagcggggcaacccgggggucaagggcugggcguucgacaacggggacgacguguggaugggccgcaccaucagcaaggaccugcgguccggcuacgagaccuucaaggugaucgggggcuggagcacccccaacuccaagagccaggucaaccgccaggugaucgucgacaacaacaacugguccggguacagcggcaucuucuccguggagggcaagagcugcaucaaccgcugcuucuacguggagcucauccgggggcgccagcaggagacgcgggucugguggaccagcaacuccaucgugguguucugcggcaccagcgggaccuacggcacgggguccuggcccgacggcgccaacaucaacuucaugcccaucuga

SEQ ID NO: 75086 - RNA, 1410 nt, Artificial Sequence
  derived and/or modified sequence opt1 from neuraminidase__InfluenzaA__AAO46223
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccgagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggagcuccagcuccugccacgacggcaaggcguggcugcacgucugcgugaccggggacgacaagaacgccaccgccagcuucaucuacgacggccggcucguggacuccaucgggagcuggucccagaacauccugcgcacgcaggagagcgagugcgucugcaucaacgggaccugcaccguggugaugaccgacggcuccgccagcgggcgggcggacacgcgcauccuguucaucgaggagggcaagaucguccacaucagcccccucuccgggagcgcccagcacguggaggagugcuccugcuacccccgguacccggacgugcgcugcaucugccgggacaacuggaagggcagcaaccgccccgucaucgacaucaacauggaggacuacuccaucgacagcuccuacgugugcagcggccuggugggggacacgccccggaacgacgaccgcuccagcaacuccaacugccgggaccccaacaacgagcgcggcaacccgggggucaagggcugggccuucgacaacggggacgacguguggaugggccggaccaucagcaaggaccugcgcuccggcuacgagaccuucaaggucaucgggggcuggagcacccccaacuccaagagccagaucaaccgccaggugaucguggacuccaacaacuggagcggguacuccggcaucuucagcgucgagggcaagagcugcaucaaccggugcuucuacguggagcucauccgcggccggaagcaggagacccgcgugugguggaccuccaacagcaucgucguguucugcggcaccuccgggacguacggcaccgggagcuggcccgacggcgccaacaucaacuucaugcccaucuga

SEQ ID NO: 75087 - RNA, 1410 nt, Artificial Sequence; identical to SEQ ID NO: 75086
  derived and/or modified sequence opt1 from neuraminidase__InfluenzaA__AAO46224

SEQ ID NO: 75088 - RNA, 1410 nt, Artificial Sequence
  derived and/or modified sequence opt1 from neuraminidase__InfluenzaA__AAO46225
augaaccccaaccagaagaucaucaccaucggcuucgugagccugaucaucgccaccgucugcuuccucaugcagaucgccauccuggcgacgaccgugacccugcacuucaagcagcacgagugcgacuccccggccagcaaccaggugaugcccugcgagcccaucaucaucgagcgcaacaucaccaagaucgucuaccucaacaacacgaccaucgagaaggagaucugccccgaggugguggaguaccggaacugguccaagccgcagugccacaucaccggguucgcccccuucagcaaggacaacuccauccgccugagcgccggcggggacaucugggucacccgggagcccuacguguccugcgaccccggcaagugcuaccaguucgcccuggggcagggcacgacccucgacaacaagcacagcaacgacaccauccacgaccgcaucccgcaccggacccugcugaugaacgagcucggcgugcccuuccaccuggggacgcgccaggucugcguggcgugguccagcuccagcugccacgacggcaaggccuggcugcacgugugcgucaccggggacgacaagaacgccaccgccuccuucaucuacgacggccggcucguggacagcaucggguccuggagccacaacauccugcgcacccaggaguccgagugcgugugcaucaacggcacgugcaccgucgugaugaccgacggcagcgcguccgggcgggccgacacccgcauccuguucaucaaggagggcaagaucgugcacaucagcccccucagcggguccgcccagcacgucgaggagugcagcugcuacccccgguacccggacgugcgcugcaucugccgggacaacuggaagggcuccaaccgccccgugaucgacaucaacauggaggacuacagcaucgacuccagcuacgucugcuccggccuggugggggacacgccccggaacaacgacggcagcuccaacagcaacugccgcgaccccaacaacgagcgggggaacccgggcgugaaggggugggccuucgacaacggcgacgacgucuggaugggccgcaccaucuccaaggaccugcggagcggguacgagaccuucaaggugaucggcgggugguccacccccaacagcaagucccaggucaaccgccaggugaucguggacaacaacaacuggagcggcuacuccgggaucuucagcgucgagggcaaguccugcaucaaccggugcuucuacguggagcucauccgcggccgccagcaggagacgcgggugugguggaccagcaacagcaucgucguguucugcgggaccuccggcaccuacgggacgggcagcuggcccgacggggccaacaucaacuucaugcccaucuga

SEQ ID NO: 75089 - RNA, 1410 nt, Artificial Sequence
  derived and/or modified sequence opt1 from neuraminidase__InfluenzaA__AAO46226
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccgagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggagcuccagcuccugccacgacggcaaggcguggcugcacgucugcgugaccggggacgacgagaacgccaccgccagcuucaucuacgacggccggcucguggacuccaucgggagcuggucccagaacauccugcgcacgcaggagagcgagugcgucugcaucaacgggaccugcaccguggugaugaccgacggcuccgccagcgggcgggcggacacgcgcauccuguucaucgaggagggcaagaucguccacaucagcccccucuccgggagcgcccagcacguggaggagugcuccugcuacccccgguacccggacgugcgcugcaucugccgggacaacuggaagggcagcaaccgccccgucaucgacaucaacauggaggacuacuccaucgacagcuccuacgugugcagcggccuggugggggacacgccccggaacgacgaccgcuccagcaacuccaacugccgggaccccaacaacgagcgcggcaacccgggggucaagggcugggccuucgacaacggggacgacguguggaugggccggaccaucagcaaggaccugcgcuccggcuacgagaccuucaaggucaucgggggcuggagcacccccaacuccaagagccagaucaaccgccaggugaucguggacuccaacaacuggagcggguacuccggcaucuucagcgucgagggcaagagcugcaucaaccggugcuucuacguggagcucauccgcggccggcagcaggagacccgcgugugguggaccuccaacagcaucgucguguucugcggcaccuccgggacguacggcaccgggagcuggcccgacggcgccaacaucaacuucaugcccaucuga

SEQ ID NO: 75090 - RNA, 1410 nt, Artificial Sequence
  derived and/or modified sequence opt1 from neuraminidase__InfluenzaA__AAO46229
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucauguaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcguggccuggagcuccagcuccugccacgacggcaaggcguggcugcacgugugcgucaccggggacgacaagaacgccaccgccagcuucaucuacgacggccggcucguggacuccaucgggagcuggucccagaacauccugcgcacgcaggagagcgagugcgugugcaucaacgggaccugcaccgucgugaugaccgacggcuccgccagcgggcgggcggacacgcgcauccuguucaucgaggagggcaagaucgugcacaucagcccccucuccgggagcgcccagcacgucgaggagugcuccugcuacccccgguacccggacgugcgcugcaucugccgggacaacuggaagggcagcaaccgccccaucaucgacaucaacauggaggacuacuccaucgacagcuccuacgugugcagcggccuggucggggacacgccccggaacgacgaccgcuccagcaacuccaacugccggaaccccaacaacgagcgcggcaacccgggggugaagggcugggccuucgacaacggggacgacguguggaugggccggaccaucagcaaggaccugcgcuccggcuacgagaccuucaaggucaucgggggcuggagcacccccaacuccaagagccagaucaaccgccaggugaucgucgacuccaacaacuggagcggguacuccggcaucuucagcguggagggcaagagcugcaucaaccggugcuucuacguggagcucauccgcggccggcagcaggagacccgcgucugguggaccuccaacagcaucgugguguucugcggcaccuccgggacguacggcaccgggagcuggcccgacggcgccaacaucaacuucaugcccaucuga

SEQ ID NO: 75091 - RNA, 1410 nt, Artificial Sequence
  derived and/or modified sequence opt1 from neuraminidase__InfluenzaA__AAO46230
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaaccucacggagaucguguaccugaacaacaccaccaucgagaaggagaucugccccgagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccucgggcagggcaccacccuggacaacaagcacuccaacgacaccauccacgaccgcaucccgcaccggacgcugcucaugaacgagcugggcguccccuuccaccuggggacccgccaggugugcguggccuggagcuccagcuccugccacgacggcaaggcguggcuccacgucugcgugaccggggacgacaagaacgccaccgccagcuucaucuacgacggccggcugguggacuccaucgggagcuggucccagaacauccugcgcacgcaggagagcgagugcgucugcaucaacgggaccugcaccguggugaugaccgacggcuccgccagcgggcgggcggacacgcgcauccucuucaucgaggagggcaagaucguccacaucagcccccuguccgggagcgcccagcacguggaggagugcuccugcuacccccgguacccggacgugcgcugcaucugccgggacaacuggaagggcagcaaccgccccgucaucgacaucaacauggaggacuacuccaucgacagcuccuacgugugcagcggccuggugggggacacgccccggaacgacgaccgcuccagcaacuccaacugccgggaccccaacaacgagcgcggcaacccgggggucaagggcugggccuucgacaacggggacgacguguggaugggccggaccaucagcaaggaccuccgcuccggcuacgagaccuucaaggucaucgggggcuggagcacccccaacuccaagagccagaucaaccgccaggugaucguggacuccaacaacuggagcggguacuccggcaucuucagcgucgagggcaagagcugcaucaaccggugcuucuacguggagcugauccgcggccggcagcaggagacccgcgugugguggaccuccaacagcaucgucguguucugcggcaccuccgggacguacggcaccgggagcuggcccgacggcgccaacaucaacuucaugcccaucuga

SEQ ID NO: 75092 - RNA, 1410 nt, Artificial Sequence
  derived and/or modified sequence opt1 from neuraminidase__InfluenzaA__AAO46231
augaaccccaaccagaagaucaucaccaucggcagcgugucccugaccaucgccacggucugcuuccucaugcagaucgccauccuggugaccaccgugacccugcacuucaagcagcacgacugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccgucaagugcuaccaguucgcccugggccaggggaccacccucgacaacaagcacuccaacgacaccgugcacgaccgcaucccgcaccggacgcugcugaugaacgagcucggcgugcccuuccaccugggcacccgccaggucugcaucgccuggagcuccagcuccugccacgacgggaaggcguggcugcacgugugcgugaccggcgacgacaagaacgccaccgccagcuucaucuacgacgggcggcucgucgacuccaucggcagcuggucccagaacauccugcgcacgcaggagagcgagugcgugugcaucaacgggaccugcaccguggucaugaccgacggcuccgccagcggccgggcggacacgcgcauccuguucaucgaggaggggaagaucgugcacaucagcccccucuccggcagcgcccagcacguggaggagugcuccugcuacccccgguacccggacguccgcugcaucugccgggacaacuggaaggggagcaaccgccccgugaucgacaucaacauggaggacuacuccaucgacagcuccuacgugugcagcggccuggucggcgacacgccccggaacgacgaccgcuccagcaacuccaacugccggaaccccaacaacgagcgcgggaacccgggcgugaaggggugggccuucgacaacggcgacgacgucuggauggggcggaccaucagcaaggaccugcgcuccggcuacgagaccuucaaggugaucggcggguggagcacccccaacuccaagagccagaucaaccgccaggugaucgucgacuccaacaacuggagcggcuacuccgggaucuucagcguggagggcaagagcugcaucaaccggugcuucuacguggagcucauccgcgggcggcagcaggagacccgcgucugguggaccuccaacagcaucgugguguucugcggcaccuccggcacguacgggaccggcagcuggcccgacggggccaacaucaacuucaugcccaucuga

SEQ ID NO: 75093 - RNA, 1410 nt, Artificial Sequence
  derived and/or modified sequence opt1 from neuraminidase__InfluenzaA__AAO46232
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccacgaucaucgagcgcaacaucaccgagaucguguaccucaacaacaccaccaucgagaaggagaucugccccaagguggucgaguaccggaacuggagcaagccgcagugccagaucacgggguucgcccccuucuccaaggacaacagcauccgccuguccgccggcggggacaucugggugacccgggagcccuacgugagcugcgaccccggcaagugcuaccaguucgcccuggggcagggcaccacccucgacaacaagcacuccaacgacacgauccacgaccgcaucccgcaccggacccugcugaugaacgagcucggcguccccuuccaccuggggacccgccaggugugcaucgccuggagcuccagcuccugccacgacggcaaggcguggcugcacgugugcgucaccggggacgacaagaacgccacggccagcuucaucuacgacggccggcucguggacuccaucgggagcuggucccagaacauccugcgcacccaggagagcgagugcgugugcaucaacgggaccugcaccgucgugaugacggacggcuccgccagcgggcgggcggacacccgcauccuguucaucgaggagggcaagaucgugcacaucagcccccucuccgggagcgcccagcacgucgaggagugcuccugcuacccccgguacccggacgugcgcugcaucugccgggacaacuggaagggcagcaaccgccccaucaucgacaucaacauggaggacuacuccaucgacagcuccuacgugugcagcggccuggucggggacacgccccggaacgacgaccgcuccagcaacuccaacugccggaaccccaacaacgagcgcggcaacccgggggugaagggcugggccuucgacaacggggacgacguguggaugggccggaccaucagcaaggaccugcgcuccggcuacgagaccuucaaggucaucgggggcuggagcacccccaacuccaagagccagaucaaccgccaggugaucgucgacuccaacaacuggagcggguacuccggcaucuucagcguggagggcaagagcugcaucaaccggugcuucuacguggagcucauccgcggccggcagcaggagacccgcgucugguggaccuccaacagcaucgugguguucugcggcacguccgggaccuacggcaccgggagcuggcccgacggcgccaacaucaacuucaugcccaucuga

SEQ ID NO: 75094 - RNA, 1410 nt, Artificial Sequence
  derived and/or modified sequence opt1 from neuraminidase__InfluenzaA__AAO46233
augaaccccaaccagaagaucaucaccaucggcagcgugucccugaccaucgccgccgucugcuuccucaugcagaucgcgauccuggugacgaccgugacccugcacuucaagcagcacgagugcgacagcccggccuccaaccaggucaugcccugcgagcccaucaucaucgagcgcaacaucaccgagaucguguaccucaacaacacgaccaucgagaaggagaucugccccaagguggucgaguaccggaacuggagcaagccgcagugccagaucaccggguucgcccccuucuccaaggacaacagcauccgccuguccgccggcggggacaucugggugacccgggagcccuacgugagcugcgaccccggcaagugcuaccaguucgcccuggggcagggcacgacccucgacaacaagcacuccaacgacaccauccacgaccgcaucccgcaccggacccugcugaugaacgagcucggcguccccuuccaccuggggacgcgccaggugugcaucgcguggagcuccagcuccugccacgacggcaaggccuggcugcacgugugcgucaccggggacgacaagaacgccaccgccagcuucaucuacgacggccggcucguggacuccaucgggagcuggucccagaacauccugcgcacccaggagagcgagugcgugugcaucaacggcacgugcaccgucgugaugaccgacggcuccgcgagcgggcgggccgacacccgcauccuguucaucgaggagggcaagaucgugcacaucagcccccucuccgggagcgcccagcacgucgaggagugcuccugcuacccccgguacccggacgugcgcugcaucugccgggacaacuggaagggcagcaaccgccccguggucgacaucaacauggaggacuacuccaucgacagcuccuacgugugcagcggccuggugggggacacgccccggaacgacgaccgcuccagcaacuccaacugccggaaccccaacaacgagcgcggcaacccgggggucaagggcugggccuucgacaacggggacgacguguggaugggccggaccaucagcaaggaccugcgcuccggcuacgagaccuucaaggucaucgggggcuggagcacccccaacuccaagagccagaucaaccgccaggugaucguggacuccaacaaccggagcggguacuccggcaucuucagcgucgaggggaagggcugcaucaaccgcugcuucuacguggagcucauccggggccgccagcaggagacgcgggugugguggaccagcaacuccaucgucguguucugcgggaccagcggcaccuacgggacgggcuccuggcccgacggggccaacaucaacuucaugcccaucuga

SEQ ID NO: 75095 - RNA, 1410 nt, Artificial Sequence
  derived and/or modified sequence opt1 from neuraminidase__InfluenzaA__AAO46235
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguacccgggcguccgcugcaucugccgggacaacuggaagggcagcaaccgccccgugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcaccccgaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggcccgacggggccaacaucaacuucaugcccaucuga

SEQ ID NO: 75096 - RNA, 1410 nt, Artificial Sequence
  derived and/or modified sequence opt1 from neuraminidase__InfluenzaA__AAO46236
augaaccccaaccagaagaucaucaccaucggcagcgugucccugaccaucgccacggucugcuuccucaugcacaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguacccgggcguccgcugcaucugccgggacaacuggaagggcagcaaccgccccgugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcaccccgaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggcccgacggggccaacaucaacuucaugcccaucuga

SEQ ID NO: 75097 - RNA, 1410 nt, Artificial Sequence
  derived and/or modified sequence opt1 from neuraminidase__InfluenzaA__AAO46237
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccaagaucguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcaucgccuggagcuccagcuccugccacgacggcaaggcguggcugcacgugugcaucaccggggacgacaagaacgccaccgccagcuucaucuacgacggccggcucguggacuccaucgggagcuggucccagaacauccugcgcacgcaggagagcgagugcgucugcaucaacgggaccugcaccguggugaugaccgacggcuccgccagcggccgggcggacacgcgcauccuguucaucgaggagggcaagaucguccacaucagcccccucuccgggagcgcccagcacguggaggagugcuccugcuacccccgguacccgggcgugcgcugcaucugccgggacaacuggaagggcagcaaccgccccgucguggacaucaacauggaggacuacuccaucgacagcuccuacgugugcagcgggcuggucggcgacacgccccggaacgacgaccgcuccagcaacuccaacugccggaaccccaacaacgagcgcgggaaccagggcgugaaggggugggccuucgacaacggcgacgacguguggaugggccggaccaucagcaaggaccugcgcuccggguacgagaccuucaaggucaucggcggguggagcaccccgaacuccaagagccagaucaaccgccaggugaucgucgacuccgacaaccggagcggcuacuccgggaucuucagcguggagggcaagagcugcaucaaccgcugcuucuacguggagcucauccggggccgcaagcaggagacccgggucugguggaccuccaacagcaucgugguguucugcgggaccuccggcacguacgggaccggcagcuggcccgacggggccaacaucaacuucaugcccaucuga

SEQ ID NO: 75098 - RNA, 1410 nt, Artificial Sequence
  derived and/or modified sequence opt1 from neuraminidase__InfluenzaA__AAO46238
augaaccccaaccagaagaucaucaccaucggcagcgccucccugaccaucgccacggugugcuuccucaugcagaucgcgauccuggucaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccaagaucguggaguaccggaacuggagcaagccgcagugcaagaucaccggguucgcccccuucuccaaggacaacagcauccgccuguccgccggcggggacaucugggugacgcgggagcccuacgucagcugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggugugcaucgcguggagcuccagcuccugccacgacggcaaggccuggcugcacgucugcgugaccggggacgacaagaacgccaccgccagcuucaucuacgacggccggcucguggacuccaucgggagcuggucccagaacauccugcgcacgcaggagagcgagugcgucugcaucaacgggaccugcaccguggugaugaccgacggcuccgcgagcgggcgggccgacacgcgcauccuguucaucgaggagggcaagaucguccacaucagcccccucuccgggagcgcccagcacguggaggagugcuccugcuacccccgguacccggacgugcgcugcaucugccgggacaacuggaagggcagcaaccgccccgucguggacaucaacauggaggacuacuccaucgacagcuccuacgugugcagcggccuggucggggacacgccccggaacgacgaccgcuccagcaacuccaacugccggaaccccaacaacgagaagggcaaccagggggugaagggcugggccuucgacaacggggacgacguguggaugggccgcaccaucagcaaggaccugcgguccggcuacgagaccuucaaggucaucgggggcuggagcaccccgaacuccaagagccagaucaaccgccaggugaucgucgacuccgacaaccggagcggguacuccggcaucuucagcguggagggcaagagcugcaucaaccgcugcuucuacguggagcucauccgcggccggaagcaggagacccgcgucugguggaccuccaacagcaucgugguguucugcggcaccuccgggacguacggcaccgggagcuggcccgacggcgccaacaucaaccugaugcccaucuga

SEQ ID NO: 75099 - RNA, 1410 nt, Artificial Sequence
  derived and/or modified sequence opt1 from neuraminidase__InfluenzaA__AAO46241
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccaagguggucggguaccggaacuggagcaagccgcagugccagaucaccggcuucgcccccuucuccaaggacaacagcauccgccuguccgccgggggcgacaucugggugacgcgggagcccuacgugagcugcgaccccgggaagugcuaccaguucgcccugggccagggcaccacccucgacaacaagcacuccaacgacaccauccacgaccgcaucccgcaccggacgcugcugaugaacgagcucgggguccccuuccaccugggcacccgccaggugugcaucgccuggagcuccagcuccugccacgacgggaaggcguggcugcacgugugcaucaccggcgacgacaagaacgccaccgccagcuucaucuacgacgggcggcucgucgacuccaucggcagcuggucccagaacauccugcgcacgcaggagagcgagugcgugugcaucaacgggaccugcaccguggucaugaccgacggcuccgccagcggccgggcggacacgcgcauccuguucaucgaggaggggaagaucgugcacaucagcccccucuccggcagcgcccagcacguggaggagugcuccugcuacccccgguacccgggcguccgcugcaucugccgggacaacuggaaggggagcaaccgccccgugguggacaucaacauggaggacuacuccaucgacagcuccuacgucugcagcggccuggugggggacacgccccggaacgacgaccgcuccagcaacuccaacugccggaaccccaacaacgagcgcggcaaccagggggugaagggcugggccuucgacaacggcgacgacgucuggauggggcggaccaucagcaaggaccugcgcuccggcuacgagaccuucaaggugaucgggggcuggagcaccccgaacuccaagagccagaucaaccggcaggucaucguggacuccgacaaccgcagcggguacuccggcaucuucagcguggagggcaagagcugcaucaaccgcugcuucuacgucgagcucauccgggggcgcaagcaggagacccgggugugguggaccuccaacagcaucguggucuucugcggcaccuccgggacguacggcaccgggagcuggcccgacggcgccaacaucaacuucaugcccaucuga

SEQ ID NO: 75100 - RNA, 1410 nt, Artificial Sequence
  derived and/or modified sequence opt1 from neuraminidase__InfluenzaA__AAO46245
augaaccccaaccagaagaucaucaccaucggcagcgugucccugaccaucgccacggucugcuuccucaugcagaucgccauccuggugaccaccgugacccugcacuucaagcagcacgacugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccgucaagugcuaccaguucgcccugggccaggggaccacccucgacaacaagcacuccaacgacaccgugcacgaccgcaucccgcaccggacgcugcugaugaacgagcucggcgugcccuuccaccugggcacccgccaggucugcaucgccuggagcuccagcuccugccacgacgggaaggcguggcugcacgugugcaucaccggcgacgacaagaacgccaccgccagcuucaucuacgacgggcggcucguggacuccaucggcagcuggucccagaacauccugcgcacgcaggagagcgagugcgucugcaucaacgggaccugcaccguggugaugaccgacggcuccgccagcggccgggcggacacgcgcauccuguucaucgaggaggggaagaucguccacaucagcccccucgccggcuccgcccagcacguggaggagugcagcugcuacccccgguacccgggggugcgcugcaucugccgggacaacuggaagggcuccaaccgccccgucguggacaucaacauggaggacuacagcaucgacuccagcuacgugugcuccggccuggucggggacacgccccggaacgacgaccgcagcuccaacagcaacugccggaaccccaacaacgagcgcggcacccagggggugaagggcugggccuucgacaacgggaacgaccuguggaugggccggaccaucuccaaggaccuccgcagcggcuacgagaccuucaaggucaucgggggcugguccaccccgaacagcaagucccagaucaaccgccaggugaucguggacagcgacaaccgguccggguacagcggcaucuucuccgucgagggcaagagcugcaucaaccgcugcuucuacguggagcugauccgggggcgcaagcaggagacccgggugugguggaccagcaacuccaucgucguguucugcggcacgagcgggaccuacggcaccggguccuggcccgacggcgccaacaucaacuucaugcccaucuga

SEQ ID NO: 75101 - RNA, 1410 nt, Artificial Sequence
  derived and/or modified sequence opt1 from neuraminidase__InfluenzaA__AAO46246
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaucaucgagaaggagaucugccccaaggugguggaguaccggaacuggagcaagccgcagugccagaucaccggguucgcccccuucuccaaggacaacagcauccgccuguccgccggcggggacaucugggucacccgggagcccuacgugagcugcgaccccggcaagugcuaccaguucgcccuggggcagggcacgacccucgacaacaagcacuccaacgacaccauccacgaccgcaccccgcaccggacgcugcugaugaacgagcucggcgugcccuuccaccuggggacccgccaggucugcaucgcguggagcuccagcuccugccacgacggcaaggccuggcugcacgugugcaucaccggggacgacaagaacgccaccgccagcuucaucuacgacggccggcucguggacuccaucgggagcuggucccagaacauccugcgcacgcaggagagcgagugcgucugcaucaacgggaccugcaccguggugaugaccgacggcuccgcgagcggccgggccgacacgcgcauccuguucaucgaggagggcaagaucguccacaucagcccccucuccgggagcgcccagcacguggaggagugcuccugcuacccccgguacccgggcgugcgcugcaucugccgggacaacuggaagggcagcaaccgccccgucguggacaucaacauggaggacuacuccaucgacagcuccuacgugugcagcgggcuggucggcgacacgccccggaacgacgaccgcuccagcaacuccaacugccggaaccccaacaacgagcgcgggaaccagggcgugaaggggugggccuucgacaacggcgacgacguguggaugggccggaccaucagcaaggaccugcgcuccggguacgagaccuucaaggucaucggcggguggagcaccccgaacuccaagagccagaucaaccgccaggugaucgucgacuccgacaaccggagcggcuacuccgggaucuucagcguggagggcaagagcugcaucaaccgcugcuucuacguggagcucauccggggccgcaagcaggagacccgggucugguggaccuccaacagcaucgccguguucugcgggaccuccggcacguacgggaccggcagcuggcccgacggggcgaacaucaacuucaugcccaucuga

SEQ ID NO: 75102 - RNA, 1410 nt, Artificial Sequence
  derived and/or modified sequence opt1 from neuraminidase__InfluenzaA__AAO46247
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguacccgggcguccgcugcaucugccgggacaacuggaagggcagcaaccgccccgugaucgacaucaacauggaggacuacuccaucgacagcuccuacgugugcagcgggcuggucggcgacacgccccggaacgacgaccgcuccagcaacuccaacugccggaaccccaacaacgagcgcgggaaccagggcgugaaggggugggccuucgacaacggcgacgacguguggaugggccggaccaucagcaaggaccugcgcuccggguacgagaccuucaaggucaucggcggguggagcaccccgaacuccaagagccagaucaaccgccaggugaucgucgacuccgacaaccggagcggcuacuccgggaucuucagcguggagggcaagagcugcaucaaccgcugcuucuacguggagcucauccggggccgcaagcaggagacccgggucugguggaccuccaacagcaucgugguguucugcgggaccuccggcacguacgggaccggcagcuggcccgacggggccaacaucaacuucaugcccaucuga

SEQ ID NO: 75103 - RNA, 1410 nt, Artificial Sequence
  derived and/or modified sequence opt1 from neuraminidase__InfluenzaA__AAO46462
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggccggacggggccaacaucaacuucaugcccaucuga

SEQ ID NO: 75104 - RNA, 1410 nt, Artificial Sequence; identical to SEQ ID NO: 75103
  derived and/or modified sequence opt1 from neuraminidase__InfluenzaA__AAO46463

SEQ ID NO: 75105 - RNA, 1410 nt, Artificial Sequence; identical to SEQ ID NO: 75103
  derived and/or modified sequence opt1 from neuraminidase__InfluenzaA__AAO46464

SEQ ID NO: 75106 - RNA, 1410 nt, Artificial Sequence; identical to SEQ ID NO: 75103
  derived and/or modified sequence opt1 from neuraminidase__InfluenzaA__AAO46465

SEQ ID NO: 75107 - RNA, 1410 nt, Artificial Sequence; identical to SEQ ID NO: 75103
  derived and/or modified sequence opt1 from neuraminidase__InfluenzaA__AAO46466

SEQ ID NO: 75108 - RNA, 1410 nt, Artificial Sequence
  derived and/or modified sequence opt1 from neuraminidase__InfluenzaA__AAO46467
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucaccggguccgcccagcacguggaggagugcagcugcuacccccgguaccccggcguccgcugcaucugccgggacaacuggaagggcuccaaccgcccggugguggacaucaacauggaggacuacagcaucgacuccagcuacgucugcuccgggcuggugggcgacacgccccggaacgacgaccgcagcuccaacagcaacugccggaaccccaacaacgagcgcgggaaccagggcgugaaggggugggccuucgacaacggcgacgacgucuggaugggccggaccaucuccaaggaccugcgcagcggguacgagaccuucaaggugaucggcgggugguccacccccaacagcaagucccagaucaaccggcaggucaucguggacagcgacaaccgcuccggcuacagcgggaucuucuccguggagggcaagagcugcaucaaccgcugcuucuacgucgagcucauccggggccgcaagcaggagacccgggugugguggaccagcaacuccaucguggucuucugcgggacgagcggcaccuacgggaccggcuccuggccggacggggccaacaucaacuucaugcccaucuga

SEQ ID NO: 75109 - RNA, 1410 nt, Artificial Sequence
  derived and/or modified sequence opt1 from neuraminidase__InfluenzaA__AAO46468
augaaccccaaccagaagaucaucaccaucggcagcgugucccugaccaucgccacggucugcuuccucaugcagaucgccauccuggugaccaccgugacccugcacuucaagcaguacgagugcgacuucccggcgagcaaccaggucaugcccugcgagcccaucaucaucgagcgcaacaucacggagaucguguaccucaacaacaccaccaucgagaaggagaucugccccaagguggucgaguaccggaacugguccaagccgcagugccagaucaccggguucgcccccuucagcaaggacaacuccauccgccugagcgccggcggggacaucugggugacgcgggagcccuacguguccugcgaccacggcaagugcuaccaguucgcccuggggcagggcaccacccucgacaacaagcacagcaacgacaccauccacgaccgcaucccccaccggacgcugcugaugaacgagcucggcgucccguuccaccuggggacccgccaggugugcaucgccugguccagcuccagcugccacgacggcaaggcguggcugcacgugugcaucaccggggacgacaagaacgccaccgccuccuucaucuacgacggccggcucgucgacagcaucggguccuggagccagaacauccugcgcacgcaggaguccgagugcgugugcaucaacgggaccugcaccguggucaugaccgacggcagcgccuccggccgggcggacacgcgcauccuguucaucgaggagggcaagaucgugcacaucagcccccucagcggguccgcccagcacguggaggagugcagcugcuacccccgguaccccggcguccgcugcaucugccgggacaacuggaagggcuccaaccgcccggugguggacaucaacauggaggacuacagcaucgacuccagcuacgucugcuccgggcuggugggcgacacgccccggaacgacgaccgcagcuccaacagcaacugccggaaccccaacaacgagcgcgggaaccagggcgugaaggggugggccuucgacaacggcgacgacgucuggaugggccggaccaucuccaaggaccugcgcagcggguacgagaccuucaaggugaucggcgggugguccacccccaacagcaagucccagaucaaccggcaggucaucguggacagcgacaaccgcuccggcuacagcgggaucuucuccguggagggcaagagcugcaucaaccgcugcuucuacgucgagcucauccggggccgcaagcaggagacccgggugugguggaccagcaacuccaucguggucuucugcgggaccagcggcacguacgggaccggcuccuggccggacggggccaacaucaacuucaugcccaucuga

SEQ ID NO: 75110 - RNA, 1410 nt, Artificial Sequence; identical to SEQ ID NO: 75103
  derived and/or modified sequence opt1 from neuraminidase__InfluenzaA__AAO46469

SEQ ID NO: 75111 - RNA, 1410 nt, Artificial Sequence
  derived and/or modified sequence opt1 from neuraminidase__InfluenzaA__AAO46471
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguacccgggcguccgcugcaucugccgggacaacuggaagggcagcaaccgccccgugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcaccccgaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggcccgacggggccaacaucaacuucaugcccaucuga

SEQ ID NO: 75112 - RNA, 1410 nt, Artificial Sequence
  derived and/or modified sequence opt1 from neuraminidase__InfluenzaA__AAO46472
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucacgaucgagcgcaacaucaccgagaucguguaccucaacaacaccaccaucgagaaggagaucugccccaagguggucgaguaccggaacuggagcaagccgcagugccagaucacgggguucgcccccuucuccaaggacaacagcauccgccuguccgccggcggggacaucugggugacccgggagcccuacgugagcugcgaccccggcaagugcuaccaguucgcccuggggcagggcaccacccucgacaacaagcacuccaacgacacgauccacgaccgcaucccgcaccggacccugcugaugaacgagcucggcguccccuuccaccuggggacccgccaggugugcaucgccuggagcuccagcuccugccacgacggcaaggcguggcugcacgugugcaucaccggggacgacaagaacgccacggccagcuucaucuacgacggccggcucgucgacuccaucgggagcuggucccagaacauccugcgcacccaggagagcgagugcgugugcaucaacgggaccugcaccguggucaugacggacggcuccgccagcggccgggcggacacccgcauccuguucaucgaggagggcaagaucgugcacaucagcccccucuccgggagcgcccagcacguggaggagugcuccugcuacccccgguacccgggcguccgcugcaucugccgggacaacuggaagggcagcaaccgccccgugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucagcggcugguccaccccgaacagcaagucccagaucaaccggcaggucaucguggacagcgacaaccgcuccggguacagcggcaucuucagcguggaggggaaguccugcaucaaccgcugcuucuacgucgagcucauccggggccgcaagcaggagacccgggugugguggaccagcaacuccaucguggucuucugcggcacgagcgggaccuacggcaccggguccuggcccgacggcgccaacaucaacuucaugcccaucuga

SEQ ID NO: 75113 - RNA, 1410 nt, Artificial Sequence; identical to SEQ ID NO: 75103
  derived and/or modified sequence opt1 from neuraminidase__InfluenzaA__AAO46473

SEQ ID NO: 75114 - RNA, 1410 nt, Artificial Sequence; identical to SEQ ID NO: 75103
  derived and/or modified sequence opt1 from neuraminidase__InfluenzaA__AAO46474

SEQ ID NO: 75115 - RNA, 1410 nt, Artificial Sequence; identical to SEQ ID NO: 75103
  derived and/or modified sequence opt1 from neuraminidase__InfluenzaA__AAO46475

SEQ ID NO: 75116 - RNA, 1410 nt, Artificial Sequence
  derived and/or modified sequence opt1 from neuraminidase__InfluenzaA__AAO46476
augaaccccaaccagaagaucaucaccaucggcagcgugucccugaccaucgccacggucugcuuccucaugcagaucgccauccuggugaccaccgugacccugcacuuccgccaguacgagugcgacagcccggcgaacaaccaggucaugcccugcgagcccacgaucaucgagcggaacaucaccgagaucguguaccucaacaacaccaccaucgagaaggagaucugccccaagcugguggaguaccgcaacugguccaagccgcagugcaagaucacgggguucgcccccuucagcaaggacaacuccauccggcugagcgccggcggggacaucugggucacccgcgagcccuacguguccugcgaccccggcaagugcuaccaguucgcccucgggcagggcaccacccuggacaacaagcacagcaacgacacgauccacgaccggaucccgcaccgcacccugcucaugaacgagcugggcgugcccuuccaccuggggacccggcaggucugcaucgccugguccagcuccagcugccacgacggcaaggcguggcuccacgugugcgugaccggggacgacaagaacgccacggccuccuucaucuacgacggccgccuggucgacagcaucggguccuggagccagaacauccugcggacccaggaguccgagugcgugugcaucaacgggaccugcaccguggucaugacggacggcagcgccuccggccgcgcggacacccggauccucuucaucgaggagggcaagaucgugcacaucagcccccugagcggguccgcccagcacguggaggagugcagcugcuacccccgcuacccgggcguccggugcaucugccgcgacaacuggaagggcuccaaccggcccgugguggacaucaacgucgaggacuacagcaucgacuccagcuacgugugcuccgggcuggugggcgacacgccccgcaacaacgaccggagcuccaacagcaacugccgcaaccccaacaacgagcgggggaaccacggcgucaaggggugggccuucgacgacggcaacgacguguggaugggccgcaccaucuccaaggaccuccggagcggguacgagaccuucaaggucaucggcgggugguccaccccgaacagcaagucccagaucaaccgccaggugaucguggacagcgacaaccgcuccggcuacagcgggaucuucuccgucgagggcaagagcugcaucaaccggugcuucuacguggagcugauccgcggccgggagcaggagacccgcgugugguggaccagcaacuccaucgucguguucugcgggacgagcggcaccuacgggaccggcuccuggcccgacggggccgacaucaaccugaugcccaucuga

SEQ ID NO: 75117 - RNA, 1410 nt, Artificial Sequence; identical to SEQ ID NO: 75103
  derived and/or modified sequence opt1 from neuraminidase__InfluenzaA__AAO46477

SEQ ID NO: 75118 - RNA, 1410 nt, Artificial Sequence
  derived and/or modified sequence opt1 from neuraminidase__InfluenzaA__AAO46478
augaaccccaaccagaagaucaucaccaucggcagcgugucccugaucaucgccaccgucugcuuccucaugcagaucgccauccuggugacgaccgugacccugcacuucaagcagcacgagugcgacagcccguccagcaaccaggucaugcccugcgagcccaucaucaucgagcgcaacaucaccgagaucguguaccucaacaacacgaccaucgagaaggagaccugccccaagcugguggaguaccggaacugguccaagccgcagugcaagaucaccggguucgcgcccuucagcaaggacaacuccauccgccugagcgccggcggggacaucugggucacgcgggagcccuacguguccugcgaccccggcaagugcuaccaguucgcccucgggcagggcaccacccuggacaacaagcacagcaacgacaccauccacgaccgcaucccgcaccggacgcugcucaugaacgagcugggcgugcccuuccaccuggggacccgccaggucugcaucgccugguccagcuccagcugccacgacggcaaggccuggcuccacgugugcgugaccggggacgacaagaacgcgaccgccuccuucaucuacgacggccggcuggucgacagcaucggguccuggagccagaacauccugcgcacgcaggaguccgagugcgugugcaucaacgggaccugcaccguggucaugaccgacggcaacgccagcgggcgggccgacacgcgcauccucuucaucgaggagggcaagaucgugcacaucagcccccuguccgggagcgcgcagcacguggaggagugcuccugcuacccccgguacccggacguccgcugcaucugccgggacaacuggaagggcagcaaccgccccaucguggacaucaacaugaaggacuacuccaucgacagcuccuacgugugcagcggccuggucggggacacgccccggaacgacgaccgcuccagcaaguccaacugccggaaccccaacaacgagcgcggcaaccacggggugaagggcugggccuucgacaacgggaacgacguguggaugggccggaccaucagcaaggaccuccgcuccggcuacgagaccuucaaggucaucgggggcuggagcaccccgaacuccaagagccagaucaaccgccaggugaucgucgacuccgacaaccggagcggguacuccggcaucuucagcguggagggcaagagcugcaucaaccgcugcuucuacguggagcugauccggggccgcgagcaggagacccgggucugguggaccuccaacagcaucgugguguucugcggcaccuccgggacguacggcaccgggagcuggcccgacggcgccaacaucaacuucaugcccaucuga

SEQ ID NO: 75119 - RNA, 1410 nt, Artificial Sequence
  derived and/or modified sequence opt1 from neuraminidase__InfluenzaA__AAO46479
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccgcgucaugcccugcgagcccaucaucaucgagcggaacaucacggagaucguguaccucaacaacaccaccaucgagaaggagaucugccccaagguggucgaguaccgcaacuggagcaagccgcagugccagaucaccggguucgcccccuucuccaaggacaacagcauccggcuguccgccggcggggacaucugggugacgcgcgagcccuacgugagcugcgaccccggcaagugcuaccaguucgcccuggggcagggcaccacccucgacaacaagcacuccaacgacaccauccacgaccggaucccgcaccgcacgcugcugaugaacgagcucggcguccccuuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcggacgcaggagagcgagugcgugugcaucaacgggaccugcaccguggucaugaccgacggcuccgccagcggccgcgcggacacgcggauccuguucaucgaggagggcaagaucgugcacaucagcccccucuccgggagcgcccagcacguggaggagugcuccugcuacccccgcuacccgggcguccggugcaucugccgcgacaacuggaagggcagcaaccggcccgugguggacaucaacauggaggacuacuccaucgacagcuccuacgucugcagcgggcuggugggcgacacgccccgcaacgacgaccgguccagcaacuccaacugccgcaaccccaacaacgagcgggggaaccagggcgugaaggggugggccuucgacaacggcgacgacgucuggaugggccgcaccaucagcaaggaccugcgguccggguacgagaccuucaaggugaucggcggguggagcaccccgaacuccaagagccagaucaaccgccaggucaucguggacuccggcaaccgcagcggguacuccggcaucuucagcguggagggcaagagcugcaucaaccggugcuucuacgucgagcucauccgcgggcggaagcaggagacccgcgugugguggaccuccaacagcaucguggucuucugcggcaccuccgggacguacggcaccgggagcuggcccgacggcgccaacaucaacuucaugcccaucuga

SEQ ID NO: 75120 - RNA, 1410 nt, Artificial Sequence
  derived and/or modified sequence opt1 from neuraminidase__InfluenzaA__AAO46481
augaaccccaaccagaagaucaucaccaucggcagcgugucccugaccaucgccacggucugcuuccucaugcagaucgccauccuggugaccaccgugacccugcacuucaagcaguacgagugcgacagcccggcgaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccucgggcagggcaccacccuggacaacaagcacagcaacgacacgauccacgaccgcaucccgcaccggacccugcucaugaacgagcugggcgugcccuuccaccuggggacccgccaggucugcaucgccugguccagcuccagcugccacgacggcaaggcguggcuccacgugugcgugaccggggacgacaagaacgccacggccuccuucaucuacgacggccggcuggucgacagcaucggguccuggagccagaacauccugcgcacccaggaguccgagugcgugugcaucaacgggaccugcaccguggucaugacggacggcagcgccuccggccgggcggacacccgcauccucuucaucgaggagggcaagaucgugcacaucagcccccugagcggguccgcccagcacguggaggagugcagcugcuacccccgguacccgggcguccgcugcaucugccgggacaacuggaagggcuccaaccgccccgugguggacaucaacgucaaggacuacagcaucgacucccgguacgugugcagcgggcuggugggcgacacgccccgcaacaacgaccgguccagcaacuccaacugccgcaaccccaacaacgagcgggggaaccacggcgucaaggggugggccuucgacgacggcaacgacguguggaugggccgcaccaucagcaaggacucccggagcggguacgagaccuucaaggucaucggcgggugguccaccccgaacagcaagucccagaucaaccgccaggugaucguggacagcgacaaccgcuccggcuacagcgggaucuucuccgucgagagcaagagcugcaucaaccggugcuucuacguggagcucauccgcggccgggagcaggagacccgcgugugguggaccuccaacagcaucgucguguucugcggcacguccgggaccuacggcaccgggagcuggcccgacggcgccgacaucaaccugaugcccaucuga

SEQ ID NO: 75121 - RNA, 1410 nt, Artificial Sequence
  derived and/or modified sequence opt1 from neuraminidase__InfluenzaA__AAO46482
augaaccccaaccagaagaucaucaccaucggcagcgugucccugaccaucgccacggucugcuuccucaugcagaucgccauccuggugaccaccgugacccugcacuucaagcaguacgagugcgacagcccggcgaacaaccaggucaugcccugcgagcccaugaucaucgagcgcaacaucacggagaucguguaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccucgggcagggcaccacccuggacaacaagcacagcaacgacacgauccacgaccgcaucccgcaccggacccugcucaugaacgagcugggcgugcccuuccaccuggggacccgccaggucugcaucgccugguccagcuccagcugccacgacggcaaggcguggcuccacgugugcgugaccggggacgacaagaacgccacggccuccuucaucuacgacggccggcuggucgacagcaucggguccuggagccagaacauccugcgcacccaggaguccgagugcgugugcaucaacgggaccugcaccguggucaugacggacggcagcgccuccggccgggcggacacccgcauccucuucaucgaggagggcaagaucgugcacaucagcccccugagcggguccgcccagcacguggaggagugcagcugcuacccccgguacccgggcguccgcugcaucugccgggacaacuggaagggcuccaaccgccccgugguggacaucaacgucaaggacuacagcaucgacucccgguacgugugcagcgggcuggugggcgacacgccccgcaacaacgaccgguccagcaacuccaacugccgcaaccccaacaacgacaaggggaaccacggcgucaaggggugggccuucgacgacggcaacgacguguggaugggccggaccaucagcaaggacucccgcagcggguacgagaccuucaaggucaucggcgggugguccaccccgaacagcaagucccagaucaaccgccaggugaucguggacagcgacaaccgguccggcuacagcgggaucuucuccgucgagggcaagagcugcaucaaccgcugcuucuacguggagcucauccggggccgcgagcaggagacccgggugugguggaccagcaacuccaucgucguguucugcgggacgagcggcaccuacgggaccggcuccuggcccgacggggccgacaucaaccugaugcccaucuga

SEQ ID NO: 75122 - RNA, 1410 nt, Artificial Sequence
  derived and/or modified sequence opt1 from neuraminidase__InfluenzaA__AAO46483
augaaccccaaccagaagaucaucaccaucggcagcgugucccugaccaucgccacggucugcuuccucaugcagaucgccauccuggugaccaccgugacccugcacuuccgccaguacgagugcgacagcccggcgaacaaccaggucaugcccugcgagcccaucaucaucgagcggaacaucacggagaucguguaccucaacaacaccaccaucgagaaggagaucugccccaagcugguggaguaccgcaacugguccaagccgcagugcaagaucaccggguucgcccccuucagcaaggacaacuccauccggcugagcgccggcggggacaucugggucacgcgcgagcccuacguguccugcgaccccggcaagugcuaccaguucgcccucgggcagggcaccacccuggacaacaagcacagcaacgacaccauccacgaccggaucccgcaccgcacgcugcucaugaacgagcugggcgugcccuuccaccuggggacccggcaggucugcaucgccugguccagcuccagcugccacgacggcaaggcguggcuccacgugugcgugaccggggacgacaagaacgccaccgccuccuucaucuacgacggccgccuggucgacagcaucggguccuggagccagaacauccugcggacgcaggaguccgagugcgugugcaucaacgggaccugcaccguggucaugaccgacggcagcgccuccggccgcgcggacacgcggauccucuucaucgaggagggcaagaucgugcacaucagcccccugagcggguccgcccagcacguggaggagugcagcugcuacccccgcuacccgggcguccggugcaucugccgcgacaacuggaagggcuccaaccggcccgugguggacaucaacgucgaggacuacagcaucgacuccagcuacgugugcuccgggcuggugggcgacacgccccgcaacaacgaccggagcuccaacagcaacugccgcaaccccaacaacgagcgggggaaccacggcgucaaggggugggccuucgacgacggcaacgacguguggaugggccgcaccaucuccaaggaccuccggagcggguacgagaccuucaaggucaucggcgggugguccaccccgaacagcaagucccagaucaaccgccaggugaucguggacagcgacaaccgcuccggcuacagcgggaucuucuccgucgagggcaagagcugcaucaaccggugcuucuacguggagcugauccgcggccgggagcaggagacccgcgugugguggaccagcaacuccaucgucguguucugcgggaccagcggcacguacgggaccggcuccuggcccgacggggccgacaucaaccugaugcccaucuga

SEQ ID NO: 75123 - RNA, 1410 nt, Artificial Sequence
  derived and/or modified sequence opt1 from neuraminidase__InfluenzaA__AAO46485
augaaccccaaccagaagaucaucaccaucggcagcgugucccugaccaucgccacggucugcuuccucaugcagaucgccauccuggugaccaccgugacccugcacuucaagcaguacgagugcgacagcccggcgaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccucgggcagggcaccacccuggacaacaagcacagcaacgacacgauccacgaccgcaucccgcaccggacccugcucaugaacgagcugggcgugcccuuccaccuggggacccgccaggucugcaucgccugguccagcuccagcugccacgacggcaaggcguggcuccacgugugcgugaccggggacgacaagaacgccacggccuccuucaucuacgacggccggcuggucgacagcaucggguccuggagccagaacauccugcgcacccaggaguccgagugcgugugcaucaacgggaccugcaccguggucaugacggacggcagcgccuccggccgggcggacacccgcauccucuucaucgaggagggcaagaucgugcacaucagcccccugagcggguccgcccagcacguggaggagugcagcugcuacccccgguacccgggcguccgcugcaucugccgggacaacuggaagggcuccaaccgccccgugguggacaucaacgucaaggacuacagcaucgacucccgguacgugugcagcgggcuggugggcgacacgccccgcaacaacgaccgguccagcaacuccaacugccgcaaccccaacaacgacaaggggaaccacggcgucaaggggugggccuucgacgacggcaacgacguguggaugggccggaccaucagcaaggacucccgcagcggguacgagaccuucaaggucaucggcgggugguccaccccgaacagcaagucccagaucaaccgccaggugaucguggacagcgacaaccgguccggcuacagcgggaucuucuccgucgagggcaagagcugcaucaaccgcugcuucuacguggagcucauccggggccgcgagcaggagacccgggugugguggaccagcaacuccaucgucguguucugcgggacgagcggcaccuacgggaccggcuccuggcccgacggggccgacaucaaccugaugcccaucuga

SEQ ID NO: 75124 - RNA, 1410 nt, Artificial Sequence
  derived and/or modified sequence opt1 from neuraminidase__InfluenzaA__AAO46486
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaucccgcaccggacccugcucaugaacgagcugggcgugcccuuccaccuggggacccgccaggugugcaucgccugguccagcuccagcugccacgacggcaaggcguggcuccacgucugcgugaccggggacgacaagaacgccacggccuccuucaucuacgacggccggcugguggacagcaucggguccuggagccagaacauccugcgcacccaggaguccgagugcgucugcaucaacgggaccugcaccguggugaugacggacggcagcgccuccggccgggcggacacccgcauccucuucaucgaggagggcaagaucguccacaucagcccccugagcggguccgcccagcacguggaggagugcagcugcuacccccgguacccgggcgugcgcugcaucugccgggacaacuggaagggcuccaaccgccccgucguggacaucaacgugaaggacuacagcaucgacuccagcuacgucugcuccgggcuggugggcgacacgccccggaacaacgaccgcagcuccaacagcuacugccggaaccccaacaacgagcgcgggaaccacggcgugaaggggugggccuucgacgacggcaacgacgucuggaugggccggaccaucuccaaggacagccgcuccggguacgagaccuucaaggugaucggcggguggagcaccccgaacuccaagagccagaucaaccggcaggucaucguggacuccgacaaccgcagcggcuacuccgggaucuucagcguggagggcaagagcugcaucaaccgcugcuucuacgucgagcucauccggggccgcgagcaggagacccgggugugguggaccuccaacagcaucguggucuucugcgggacguccggcaccuacgggaccggcagcuggcccgacggggccgacaucaaccugaugcccaucuga

SEQ ID NO: 75125 - RNA, 1410 nt, Artificial Sequence
  derived and/or modified sequence opt1 from neuraminidase__InfluenzaA__AAO46489
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccugaacaacaagcacagcaacgacacgauccacgaccgcaucccgcaccggacccugcucaugaacgagcugggcgugcccuuccaccuggggacccgccaggugugcaucgccugguccagcuccagcugccacgacggcaaggcguggcuccacgucugcgugaccggggacgacaagaacgccacggccuccuucaucuacgacggccggcugguggacagcaucggguccuggagccagaacauccugcgcacccaggaguccgagugcgucugcaucaacgggaccugcaccguggugaugacggacggcagcgccuccggcaaggcggacacccggauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccagcuccuacugccgcaaccccaacaacgagcgggggaaccacggcgugaaggggugggccuucgacgacggcaacgacgucuggaugggccgcaccaucagcaaggacucccggagcggguacgagaccuucaaggugaucggcgggugguccaccccgaacagcaagucccagaucaaccgccaggucaucguggacagcgacaaccgguccggcuacagcgggaucuucagcguggagggcaaguccugcaucaaccgcugcuucuacgucgagcucauccgcggccgggagcaggagacccgcgugugguggaccagcaacuccaucguggucuucugcgggacgagcggcaccuacgggaccggcuccuggcccgacggggccgacaucaaccugaugcccaucuga

SEQ ID NO: 75126 - RNA, 1410 nt, Artificial Sequence
  derived and/or modified sequence opt1 from neuraminidase__InfluenzaA__AAO46491
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccaacagcuacugccgcaaccccaacaacgagaaggggaaccacggcgugaaggggugggccuucgacgacggcaacgacgucuggaugggccggaccaucuccgaggacagccgcuccggguacgagaccuucaaggugaucggcggguggagcaccccgaacuccaagcuccagaucaaccggcaggucaucguggacagcgacaaccgcuccggcuacagcgggaucuucuccguggagggcaagagcugcaucaaccggugcuucuacgucgagcugauccgcggccgcgagcaggagacccgggugugguggacgagcaacuccaucguggucuucugcgggaccagcggcaccuacgggaccggcuccuggcccgacggggccgacaucaaccugaugcccaucuga

SEQ ID NO: 75127 - RNA, 1410 nt, Artificial Sequence; identical to SEQ ID NO: 75126
  derived and/or modified sequence opt1 from neuraminidase__InfluenzaA__AAO46492

SEQ ID NO: 75128 - RNA, 1410 nt, Artificial Sequence
  derived and/or modified sequence opt1 from neuraminidase__InfluenzaA__AAO88264
augaacaccaaccagcgcaucaucaccaucggcacggugugccugaucgucgggaucgugagccuccugcugcagaucggcaacaucgugucccucuggaucagccacuccauccagaccgggaagaagaacuacagcaagaucugcuccaagagcgucaucaccuacgagaacaacaccugggugaaccagacguacgugaacaucuccaacaucaacaucgccgacggccagggggucaacagcaucauccuggccggcaacuccagccugugccccaucuccggcugggcgaucuacagcaaggacaacuccauccggaucgggagcaagggcgacaucuucgugauccgcgagccguucaucuccugcagccaccucgagugccggaccuucuuccugacccagggggcccugcucaacgaccgccacuccaacggcaccgugaaggaccggagccccuaccgcacgcugauguccugccccaucggggaggcccccagcccguacaacagccgguucgaguccgucgccuggagcgccuccgcgugccacgacggcaugggcuggcugaccaucgggaucagcggccccgacaacggggccguggccgugcucaaguacaacggcaucaucaccgacaccaucaaguccuggcgcaacaagauccugcggacgcaggagagcgagugcgucugcaucaacggcuccugcuucaccaucaugaccgacgggcccagcaacggccaggccuccuacaagaucuucaagauggagaaggggaagaucaucaagagcguggagcuggacgcgcccaacuaccacuacgaggagugcuccugcuacccggacaccggcaagguggucugcgugugcagcgacaacuggcacgccuccaaccgccccugggugagcuucgaccagaaccucgacuaccagaucggguacaucugcuccggcgucuucggcgacaacccccggagcaacgacgggcgcggcaacugcgggcccgugcuguccaacggcgccaacggggugaagggcuucagcuuccgguacggcaacggggucuggaucggccgcacgaaguccaucagcagccgguccggguucgagaugaucugggacccgaacggcuggaccgagaccgacagcuccuucagcaucaagcaggacgugaucgcccugaccgacugguccggguacagcggcuccuucgugcagcaccccgagcucacgggcaugaacugcauccgccccugcuucugggucgagcugauccgggggcagcccaaggagagcaccaucuggaccuccggcagcuccaucagcuucugcgggguggacuccgagaccgccagcugguccuggccggacggcgcggaccugcccuucacgaucgacaaguga

SEQ ID NO: 75129 - RNA, 1410 nt, Artificial Sequence
  derived and/or modified sequence opt1 from neuraminidase__InfluenzaA__AAQ10334
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaagaucaccggguucgcccccuucuccaaggacaacagcauccgccucuccgccggcggggacaucugggugacccgggagcccuacgugagcugcgacccgggcaagugcuaccaguucgcccuggggcagggcaccacgcugaacaaccgccacuccaacgacaccguccacgaccggacccccuaccgcacccuccugaugaacgagcugggcgugcccuuccaccucgggacgaagcaggucugcaucgccuggagcuccagcuccugccacgacggcaaggcguggcugcacgugugcgugaccgggcacaacgagaacgccaccgccagcuucaucuacaacggccggcugguggacuccaucgggagcugguccaagaacauccuccgcacccaggagagcgagugcgucugcaucaacggcacgugcaccguggugaugaccgacggcuccgccagcgggcgggcggacaccaagauccuguucaucgaggagggcaagaucguccacaucagcccccuguccgggagcgcccagcacguggaggagugcuccugcuacccgcgcuaccccggcgugcggugcgucugccgcgacaacuggaagggcagcaaccggcccaucguggacaucaacgugaaggacuacuccaucgucagcuccuacgugugcagcgggcucgugggcgacacgccccgcaagaacgacuccagcuccagcuccuacugccugaacccgaacaacgaggagggcgggcacggggucaagggcugggccuucgacgacggcaacgacguguggauggggcggaccaucagcgagaagcugcgcuccggcuacgagaccuucaaggucaucgggggcuggagcaagcccaacuccaagcuccagaucaaccgccaggugaucguggaccgggggaaccggagcggcuacuccggcaucuucagcgucgaggggaaguccugcaucaaccgcugcuucuacguggagcugauccggggccgcaagcaggagaccgaggugugguggacgagcaacagcaucgucguguucugcgggaccuccggcaccuacgggaccggcagcuggcccgacggcgccgacaucaaccugaugcccaucuga

SEQ ID NO: 75130 - RNA, 1410 nt, Artificial Sequence; identical to SEQ ID NO: 75129
  derived and/or modified sequence opt1 from neuraminidase__InfluenzaA__AAQ10335

SEQ ID NO: 75131 - RNA, 1410 nt, Artificial Sequence
  derived and/or modified sequence opt1 from neuraminidase__InfluenzaA__AAQ10336
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaagaucaccggguucgcccccuucuccaaggacaacagcauccgccucuccgccggcggggacaucugggugacccgggagcccuacgugagcugcgacccgggcaagugcuaccaguucgcccuggggcagggcaccacgcugaacaaccgccacuccaacgacaccguccacgaccggacccccuaccgcacccuccugaugaacgagcugggcgugcccuuccaccucgggacgaagcaggucugcaucgccuggagcuccagcuccugccacgacggcaaggcguggcugcacgugugcgugaccgggcacaacgagaacgccaccgccagcuucaucuacaacggccggcugguggacuccaucgggagcugguccaagaacauccuccgcacccaggagagcgagugcgucugcaucaacggcacgugcaccguggugaugaccgacggcuccgccagcgggcgggcggacaccaagauccuguucaucgaggagggcaagaucguccacaucagcccccuguccgggagcgcccagcacguggaggagugcuccugcuacccgcgcuaccccggcgugcggugcgucugccgcgacaacuggaagggcagcaaccggcccaucguggacaucaacgugaaggacuacuccaucgucagcuccuacgugugcagcgggcucgugggcgacacgccccgcaagaacgacuccagcuccagcuccuacugccugaacccgaacaacgaggagggcgggcacggggucaagggcugggccuucgacgacggcaacgacguguggauggggcggaccaucagcgagaagcugcgcuccggcuacgagaccuucaaggucaucgggggcuggagcaagcccaacuccaagcuccagaucaaccgccaggugaucguggaccgggggaaccggagcggcuacuccggcaucuucagcgucgaggggaaguccugcaucaaccgcugcuucuacguggagcugauccggggccgcaagcaggagaccgaggugugguggacgagcaacagcaucgucguguucugcgggaccuccggcaccuacgggaccggcagcuggcccgacggcgccgagaucaaccugaugcccaucuga

SEQ ID NO: 75132 - RNA, 1410 nt, Artificial Sequence; identical to SEQ ID NO: 75129
  derived and/or modified sequence opt1 from neuraminidase__InfluenzaA__AAQ10337

SEQ ID NO: 75133 - RNA, 1410 nt, Artificial Sequence
  derived and/or modified sequence opt1 from neuraminidase__InfluenzaA__AAQ10339
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagccacugccugaaccccaacaacgaggagggcgggcacggcgucaaggggugggccuucgacgacggcaacgacguguggaugggccggaccaucuccgagacccugcgcagcggguacgagaccuucaaggucaucgagggcugguccaagccgaacagcaagcuccagaucaaccgccaggugaucguggaccgggggaaccgguccggcuacagcgggaucuucuccgucgagggcaagagcugcaucaaccgcugcuucuacguggagcugauccggggccgcaagcaggagacggaggugugguggaccagcaacuccaucgucguguucugcgggaccagcggcaccuacgggacgggcuccuggcccgacggggccgacaucaaccugaugcccaucuga

SEQ ID NO: 75134 - RNA, 1410 nt, Artificial Sequence
  derived and/or modified sequence opt1 from neuraminidase__InfluenzaA__AAQ10341
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagccacugccugaaccccaacaacgaggagggcgggcacggcgucaaggggugggccuucgacgacggcaacgacguguggaugggccggaccaucuccgagaagcugcgcagcggguacgagaccuucaaggucaucgagggcugguccaagccgaacagcaagcuccagaucaaccgccaggugaucguggaccgggggaaccgguccggcuacagcgggaucuucuccgucgagggcaagagcugcaucaaccgcugcuucuacguggagcugauccggggccgcaagcaggagaccgaggugugguggacgagcaacuccaucgucguguucugcgggaccagcggcaccuacgggaccggcuccuggcccgacggggccgacaucaaccugaugcccaucuga

SEQ ID NO: 75135 - RNA, 1410 nt, Artificial Sequence
  derived and/or modified sequence opt1 from neuraminidase__InfluenzaA__AAQ10343
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgccagcggccgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacggcaacgacguguggaugggccggaccaucagcgagaaguuccgcuccggguacgagaccuucaaggucaucgagggcuggagcaagccgaacuccaagcugcagaucaaccgccaggugaucguggaccgggggaaccggagcggcuacuccgggaucuucagcgucgagggcaagagcugcaucaaccgcugcuucuacguggagcucauccggggccgcaagcaggagaccgaggugugguggacguccaacagcaucgucgccuucugcgggaccuccggcaccuacgggaccggcagcuggcccgacggggccgacaucaaccugaugcccaucuga

SEQ ID NO: 75136 - RNA, 1191 nt, Artificial Sequence
  derived and/or modified sequence opt1 from neuraminidase__InfluenzaA__AAQ10344
augaaccccaaccagaagaucaucaccaucggcagcgugucccugaccaucgccaccaucugcuuccucaugcagaucgccauccuggucaccaccgugacccugcacuucaagcaguacgagugcaacagcccgcccaacaaccaggcgaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcccccuucagcaaggacaacuccauccgccucagcgccggcggggacaucugggucacccgggagcccuacguguccugcgaccccgacaagugcuaccaguucgcccugggccaggggaccacgcugaacaaccgccacagcaacgacaccgugcacgaccggaccccguaccgcacccuccugaugaacgagcugggcguccccuuccaccucggcacgaagcaggucugcaucgcgugguccagcuccagcugccacgacgggaaggccuggcugcacgugugcgugaccggccacgacgagaacgccaccgccuccuucaucuacgacgggcggcugguggacagcaucggcuccuggagcaagaagauccuccgcacccaggaguccgagugcgugugcaucaacgggacgugcaccgucgugaugaccgacggcagcgcguccggccgggccgacaccaagauccuguucaucgaggaggggaagaucgugcacacgagcaagcugagcggcuccgcccagcacgucgaggagugcagcugcuacccccgcuaccccggggugcggugcgugugccgcgacaacuggaagggcuccaaccggccgaucgucgacaucaacgugaaggacuacagcaucguguccagcuacgucugcuccggccucgugggggacacgccccgcaagaacgacagcuccagcuccagccacugccugaaccccaacaacgaggagggcgggcacggcgugaaggggugggccuucgacgacggcaacgacgucuggaugggccggaccaucuccgagaaguuccgcagcggguacgagaccuucaaggugaucgagggcugguccaagcccaacagcaagcugcagaucaacuccaagagcuga

SEQ ID NO: 75137 - RNA, 1416 nt, Artificial Sequence
  derived and/or modified sequence opt1 from neuraminidase__InfluenzaA__AAR11366
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaaccugaccugcaccacgaucaaccagaacaacaccaccgucguggagaacaccuacgugaacaacacgaccaucaucaccaagggcaccgaccucaagacgcccagcuaccugcugcucaacaagucccugugcaacgucgagggguggguggugaucgccaaggacaacgccguccgcuucggcgagagcgagcagaucaucgugacccgggagcccuacguguccugcgaccccaccggcugcaagauguacgcccugcaccaggggaccacgauccgcaacaagcacagcaacggcaccauccacgaccggaccgccuuccgcgggcucaucuccaccccgcugggcacgccgcccaccgucagcaacuccgacuucaugugcgugggguggagcuccacgaccugccacgacggcaucgcgcggaugaccaucugcauccagggcaacaacgacaacgccaccgccaccguguacuacaaccgccggcugaccacgaccaucaagaccugggcccgcaacauccuccggacccaggagagcgagugcgucugccacaacgggacgugcgcgguggugaugaccgacggcuccgccagcucccaggccuacaccaaggucauguacuuccacaaggggcugguggugaaggaggaggagcugcgcggcagcgcccggcacaucgaggagugcuccugcuacggccacaaccagaaggugaccugcgucugccgcgacaacuggcagggggccaaccggcccaucaucgagaucgacaugaacacgcucgagcacaccagccgcuacgugugcaccggcauccugaccgacacgagccggcccggggacaaguccagcggcgacugcuccaaccccaucaccgggagccccggcgcgcccggcgucaagggguucggcuuccugaacggggacaacaccuggcucggccgcaccaucuccccgcggagccgcuccggguucgagaugcugaagauccccaacgccggcaccgaccccaacagccggaucgccgagcgccaggagaucguggacaacaacaacugguccggcuacagcggguccuucaucgacuacuggaacgacaacagcgagugcuacaaccccugcuucuacgucgagcugauccggggccgcccggaggaggccaaguacgugugguggacguccaacagccucaucgcccugugcgggucccccuuccccgugggccccgggagcuucccggacggcgcgcagauccaguacuucuccuga

SEQ ID NO: 75138 - RNA, 1350 nt, Artificial Sequence
  derived and/or modified sequence opt1 from neuraminidase__InfluenzaA__AAS89005
augaaccccaacaagaagaucaucaccaucggcagcaucugcauggugaccgggauggucucccugaugcuccagaucggcaaccugaucagcaucugggugucccacagcauccacacggggaaccagcagaaggccgagccgaucuccaacaccaacuuccugaccgagaaggccguggcgagcgucaagcucgccggcaacuccagccugugccccaucaacgggugggccguguacuccaaggacaacagcauccgcaucggcuccaagggcgacguguucgucauccgggagcccuucaucagcugcucccaccuggagugccgcaccuucuuccucacgcagggggcccugcugaacgacaagcacagcaacggcaccgugaaggaccggagcccccaccgcacccucauguccugcccggugggggaggcccccucccccuacaacagccgguucgaguccgucgcguggagcgccagcgccugccacgacggcaccuccuggcugacgaucgggaucagcggccccgacuccggcgccguggcggugcugaaguacaacgggaucaucaccgacaccaucaagagcuggcgcaacaacauccuccggacccaggaguccgagugcgccugcgucaacggcagcugcuucacggugaugaccgacgggccguccaacggccaggccagccacaagaucuucaagauggagaagggcaagguggucaaguccguggagcuggacgcccccaacuaccacuacgaggagugcagcugcuaccccgacgccggggagaucacgugcgugugccgcgacaacuggcacggcuccaaccggcccugggucagcuucaaccagaaccuggaguaccagaucggguacaucugcuccggcguguucggggacaacccgcgccccaacgacggcaccggcagcugcgggcccguguccagcaacggcgcguacggggucaagggcuucuccuucaaguacgggaacggcguguggaucggccggaccaagagcaccaacucccgcagcggguucgagaugaucugggaccccaacggcuggaucgagaccgacagcuccuucagcgugaagcaggacaucgucgccaucaccgacugguccggguacagcggcuccuucgugcagcacccggagcucacggggcuggacugcauccggcccugcuucugggucgagcugauccgcggccggcccaaggagagcaccaucuggaccuccggcagcuccaucagcuucugcggggugaacuccgacaccgugggcuggagcuggcccgacggggccgagcucccguucacgaucgacaaguga

SEQ ID NO: 75139 - RNA, 1350 nt, Artificial Sequence
  derived and/or modified sequence opt1 from neuraminidase__InfluenzaA__AAS89006
augaaccccaacaagaagaucaucaccaucggcagcaucugcauggugaccgggauggucucccugaugcuccagaucggcaaccugaucagcaucugggugucccacagcauccacacggggaaccagcacaaggccgagccgaucuccaacaccaacuuccugaccgagaaggccguggcgagcgucaagcucgccggcaacuccagccugugccccaucaacgggugggccguguacuccaaggacaacagcauccgcaucggcuccaagggcgacguguucgucauccgggagcccuucaucagcugcucccaccuggagugccgcaccuucuuccucacgcagggggcccugcugaacgacaagcacagcaacggcaccgugaaggaccggagcccccaccgcacccucauguccugcccggugggggaggcccccucccccuacaacagccgguucgaguccgucgcguggagcgccagcgccugccacgacggcaccuccuggcugacgaucgggaucagcggccccgacaacggcgccguggcggugcugaaguacaacgggaucaucaccgacaccaucaaguccuggcgcaacaacauccuccggacccaggagagcgagugcgccugcgucaacggcuccugcuucacggugaugaccgacgggccgagcaacggccaggccucccacaagaucuucaagauggagaagggcaagguggucaagagcguggagcuggacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagcuccaacggcgcguacggggucaagggcuucagcuucaaguacgggaacggcguguggaucggccggaccaaguccaccaacagccgcuccggguucgagaugaucugggaccccaacggcuggaccgagaccgacagcagcuucuccgugaagcaggacaucgucgccaucacggacuggagcggguacuccggcagcuucgugcagcacccggagcucaccgggcuggacugcauccggcccugcuucugggucgagcugauccgcggccggcccaaggaguccaccaucuggaccagcggcuccagcaucuccuucugcggggugaacagcgacacggugggcugguccuggcccgacggggccgagcucccguucaccaucgacaaguga

SEQ ID NO: 75140 - RNA, 1410 nt, Artificial Sequence
  derived and/or modified sequence opt1 from neuraminidase__InfluenzaA__AAT38822
augaaccccaaccagaagaucaucaccaucggcguggucaacaccacgcugagcaccaucgcccucuucaucggggugggcaaccugguguucaacaccgucauccacgagaagaucggggaccaccagaucgugacccacccgacgaucaugacccccgaggugcccaacugcuccgacaccaucaucaccuacaacaacacggucaucaacaacaucaccaccaccaucaucacggaggccgagcgccccuucaagagcccgcugccccucugccccuuccggggcuucuuccccuuccacaaggacaacgcgauccgccugggggagaacaaggacgugaucgugacccgggagccguacgucuccugcgacaacgacaacugcuggagcuucgcccuggcccagggcgcccuccugggcaccaagcacuccaacgggaccaucaaggaccgcacgcccuaccggagccugauccgcuuccccaucggcaccgcccccgugcucgggaacuacaaggagaucugcaucgcgugguccagcuccagcugcuucgacggcaaggaguggaugcacgugugcaugaccgggaacgacaacgacgccuccgcccagaucaucuacggcggccggaugaccgacagcaucaaguccuggcgcaaggacauccugcggacgcaggagagcgagugccagugcaucgacgggaccugcgucguggccgugaccgacggcccggcggccaacuccgccgaccaccgcgucuacuggauccgggaggggcgcaucaucaaguacgagaacgugcccaagaccaagauccagcaccuggaggagugcagcugcuacguggacaucgacgucuacugcaucugccgggacaacuggaagggcuccaaccgccccuggaugcggaucaacaacgagacgauccucgagaccggcuacgugugcagcaaguuccacuccgacacgccccgcccggccgaccccagcaucaugagcugcgacucccccagcaacgugaacgggggccccggggucaagggcuucggguucaaggccggcaacgacguguggcugggccggaccguguccaccagcgggcgcuccggcuucgagaucaucaaggucaccgagggguggaucaacagcccgaaccacgugaaguccaucacccagacccuggucagcaacaacgacugguccggcuacagcggguccuucaucgugaaggcgaaggacugcuuccagcccugcuucuacguggagcucauccggggccgccccaacaagaacgacgacgucagcuggacguccaacagcaucgugaccuucugcggccuggacaacgagcccggguccggcaacuggccggacgggagcaacaucggcuucaugcccaaguga

SEQ ID NO: 75141 - RNA, 1350 nt, Artificial Sequence; identical to SEQ ID NO: 75139
  derived and/or modified sequence opt1 from neuraminidase__InfluenzaA__AAV65827

SEQ ID NO: 75142 - RNA, 1410 nt, Artificial Sequence
  derived and/or modified sequence opt1 from neuraminidase__InfluenzaA__AAX11488
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcgcccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcacguccgggaccuacggcaccgggagcuggccggacggcgcggacaucaaccugaugcccaucuga

SEQ ID NO: 75143 - RNA, 1410 nt, Artificial Sequence
  derived and/or modified sequence opt1 from neuraminidase__InfluenzaA__AAX11508
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacaacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75144 - RNA, 1410 nt, Artificial Sequence
  derived and/or modified sequence opt1 from neuraminidase__InfluenzaA__AAX11538
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgagcgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuccagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccagcaacuccaucgucguguucugcggcaccagcgggaccuacggcacgggguccuggccggacggcgccgacaucaaccugaugcccaucuga

SEQ ID NO: 75145 - RNA, 1410 nt, Artificial Sequence
  derived and/or modified sequence opt1 from neuraminidase__InfluenzaA__AAX11548
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuccagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccagcaacuccaucgucguguucugcggcaccagcgggaccuacggcacgggguccuggccggacggcgccgacaucaaccugaugcccaucuga

SEQ ID NO: 75146 - RNA, 1410 nt, Artificial Sequence; identical to SEQ ID NO: 75143
  derived and/or modified sequence opt1 from neuraminidase__InfluenzaA__AAX11558

SEQ ID NO: 75147 - RNA, 1410 nt, Artificial Sequence
  derived and/or modified sequence opt1 from neuraminidase__InfluenzaA__AAX11568
augaaccccaaccagaagaucaucaccaucggcagcgugucccugaccaucgccacgaucugcuuccucaugcagaucgccauccuggucaccaccgugacccugcacuucaagcagcacgagugcuacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75148 - RNA, 1410 nt, Artificial Sequence; identical to SEQ ID NO: 75143
  derived and/or modified sequence opt1 from neuraminidase__InfluenzaA__AAX11578

SEQ ID NO: 75149 - RNA, 1410 nt, Artificial Sequence
  derived and/or modified sequence opt1 from neuraminidase__InfluenzaA__AAX11588
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcaucugcaucaacgggaccugcacggucgugaugaccgacggcagcgcguccgggaaggccgacaccaagauccuguucaucgaggagggcaagaucgugcacaucagcacccugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuucuccagcucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggucaucguggagcggggcaaccgcagcggguacuccggcaucuucagcguggagggcaaguccugcaucaaccggugcuucuacgucgagcugauccgcgggcggaaggagaagaccgaggugugguggacgagcaacagcaucguggucuucugcggcaccuccgggaccuacggcaccgggagcuggccggacggcgccgacaucaaccugaugcccaucuga

SEQ ID NO: 75150 - RNA, 1410 nt, Artificial Sequence; identical to SEQ ID NO: 75145
  derived and/or modified sequence opt1 from neuraminidase__InfluenzaA__AAX11598

SEQ ID NO: 75151 - RNA, 1410 nt, Artificial Sequence; identical to SEQ ID NO: 75145
  derived and/or modified sequence opt1 from neuraminidase__InfluenzaA__AAX11608

SEQ ID NO: 75152 - RNA, 1410 nt, Artificial Sequence
  derived and/or modified sequence opt1 from neuraminidase__InfluenzaA__AAX11618
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcgcccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuccagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggacgagcaacuccaucgucguguucugcggcaccagcgggaccuacggcaccggguccuggccggacggcgccgacaucaaccugaugcccaucuga

SEQ ID NO: 75153 - RNA, 1410 nt, Artificial Sequence
  derived and/or modified sequence opt1 from neuraminidase__InfluenzaA__AAX12744
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75154 - RNA, 1410 nt, Artificial Sequence; identical to SEQ ID NO: 75145
  derived and/or modified sequence opt1 from neuraminidase__InfluenzaA__AAX12754

SEQ ID NO: 75155 - RNA, 1410 nt, Artificial Sequence
  derived and/or modified sequence opt1 from neuraminidase__InfluenzaA__AAX12774
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucgucaacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 75156 - RNA, 1410 nt, Artificial Sequence
  derived and/or modified sequence opt1 from neuraminidase__InfluenzaA__AAX12804
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacaacuucagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaccaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccuccaacagcaucgucguguucugcggcaccagcgggacguacggcaccggguccuggccggacggcgccgacaucaaccugaugcccaucuga

SEQ ID NO: 75157 - RNA, 1410 nt, Artificial Sequence
  derived and/or modified sequence opt1 from neuraminidase__InfluenzaA__AAX12814
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucgucaacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 75158 - RNA, 1410 nt, Artificial Sequence
  derived and/or modified sequence opt1 from neuraminidase__InfluenzaA__AAX34064
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagcgggagaucugccccaagcuggcggaguaccgcaacugguccaagccgcagugcaacaucaccggguucgcccccuucagcaaggacaacuccauccggcucagcgccggcggggacaucugggugacccgcgagcccuacguguccugcgaccccgacaagugcuaccaguucgcccugggccaggggaccacgcugaacaacggccacagcaacgacaccguccacgaccggaccccguaccgcacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagcccaacagcaagcuccagaucaaccgccaggugaucguggagcggggcaaccgguccggguacagcggcaucuucuccgucgagggcaagagcugcaucaaccgcugcuucuacguggagcugauccgggggcgcaaggaggagaccgaggugugguggaccagcaacuccaucgucguguucugcggcaccagcgggaccuacggcacgggguccuggccggacggcgccgacaucaaccugaugcccaucuga

SEQ ID NO: 75159 - RNA, 1410 nt, Artificial Sequence
  derived and/or modified sequence opt1 from neuraminidase__InfluenzaA__AAX35824
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccuggcgaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucauccacaucagcacccugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuccagcuccagccacugccuggaccccaacaacgaggagggcggccacggggugaagggcugggccuucgacgacggcaacgacgucuggauggggcgcaccaucuccgagaagcugcggagcggcuacgagaccuucaaggugaucgaggggugguccaagcccaacagcaagcuccagaucaaccgccaggucaucguggagcggggcaaccgcuccggguacagcggcaucuucuccguggagggcaagagcugcaucaaccggugcuucuacgucgagcugauccgcgggcggaaggaggagaccgaggugugguggacgagcaacuccaucguggucuucugcggcaccagcgggaccuacggcaccggguccuggccggacggcgccgacaucaaccugaugcccaucuga

SEQ ID NO: 75160 - RNA, 1410 nt, Artificial Sequence; identical to SEQ ID NO: 75143
  derived and/or modified sequence opt1 from neuraminidase__InfluenzaA__AAX35834

SEQ ID NO: 75161 - RNA, 1410 nt, Artificial Sequence
  derived and/or modified sequence opt1 from neuraminidase__InfluenzaA__AAX35844
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccaacagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguucaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacuccaucgucguguucugcggcaccagcgggaccuacggcacggggagcuggccggacggcgccgacaucaaccugaugcccaucuga

SEQ ID NO: 75162 - RNA, 1410 nt, Artificial Sequence
  derived and/or modified sequence opt1 from neuraminidase__InfluenzaA__AAX35854
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75163 - RNA, 1410 nt, Artificial Sequence
  derived and/or modified sequence opt1 from neuraminidase__InfluenzaA__AAX35864
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacaacggccggcugguggacagcaucggguccuggagcaagaacauccuccgcacccaggaguccgagugcgucugcaucaacgggaccugcacgguggugaugaccgacggcagcgcguccgggaaggccgacaccaagauccuguucaucgaggagggcaagaucgucaacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 75164 - RNA, 1410 nt, Artificial Sequence
  derived and/or modified sequence opt1 from neuraminidase__InfluenzaA__AAX47538
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgaggaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucgucaacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 75165 - RNA, 1410 nt, Artificial Sequence; identical to SEQ ID NO: 75143
  derived and/or modified sequence opt1 from neuraminidase__InfluenzaA__AAX56383

SEQ ID NO: 75166 - RNA, 1410 nt, Artificial Sequence
  derived and/or modified sequence opt1 from neuraminidase__InfluenzaA__AAX56393
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggcaaggggaccacgcugaacaacggccacagcaacaacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75167 - RNA, 1410 nt, Artificial Sequence; identical to SEQ ID NO: 75143
  derived and/or modified sequence opt1 from neuraminidase__InfluenzaA__AAX56413

SEQ ID NO: 75168 - RNA, 1410 nt, Artificial Sequence; identical to SEQ ID NO: 75145
  derived and/or modified sequence opt1 from neuraminidase__InfluenzaA__AAX56423

SEQ ID NO: 75169 - RNA, 1410 nt, Artificial Sequence; identical to SEQ ID NO: 75143
  derived and/or modified sequence opt1 from neuraminidase__InfluenzaA__AAX56433

SEQ ID NO: 75170 - RNA, 1410 nt, Artificial Sequence; identical to SEQ ID NO: 75162
  derived and/or modified sequence opt1 from neuraminidase__InfluenzaA__AAX56443

SEQ ID NO: 75171 - RNA, 1410 nt, Artificial Sequence
  derived and/or modified sequence opt1 from neuraminidase__InfluenzaA__AAX56473
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaagaacugcaucaaccggugcuucuacguggagcugauccgcgggcggaaggaggagaccgaggugugguggaccuccaacagcaucgucguguucugcggcaccagcgggaccuacggcacgggguccuggccggacggcgccgacaucaaccugaugcccaucuga

SEQ ID NO: 75172 - RNA, 1410 nt, Artificial Sequence
  derived and/or modified sequence opt1 from neuraminidase__InfluenzaA__AAX56483
augaaccccaaccagaagaucaucaccaucggcagcgugucccugaccaucgccacgaucugcuuccucaugcagaucgccauccuggucaccaccgugacccugcacuucaagcaguacgagugcgacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75173 - RNA, 1410 nt, Artificial Sequence; identical to SEQ ID NO: 75172
  derived and/or modified sequence opt1 from neuraminidase__InfluenzaA__AAX56503

SEQ ID NO: 75174 - RNA, 1410 nt, Artificial Sequence
  derived and/or modified sequence opt1 from neuraminidase__InfluenzaA__AAX56513
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 75175 - RNA, 1413 nt, Artificial Sequence
  derived and/or modified sequence opt1 from neuraminidase__InfluenzaA__AAX56533
augaaccccaaccagaagaucaucaccaucggcagcaucuccguggccaucgggaucaucagccugauccuccagaucggcaacaucaucuccaucugggccagccacuccauccagaccgggagccagaacuacacgggcaucugcaaccagcgcaucaucaccuacgagaaccggaccugggucaaccagaccuacgugaacaucaacaacacgaacguggucgcggggaaggacaagaccuccaugacccuggccggcaacagcucccugugcccgauccgcggcugggccaucuacaccaaggacaacagcauccggaucggguccaagggcgacguguucgugauccgcgagcccuucaucagcugcucccaccucgagugccggacguucuuccugacccagggggcccugcucaacgacaagcacagcaacggcaccaucaaggaccgcucccccuuccgggcccugaugagcugcccccugggggaggcgccgucccccuacaacagccgcuucgaguccgucgccuggagcgccagcgccugccacgacggccucggcuggcugaccaucgggaucuccggccccgacaacggggcgguggccgugcugaaguacaacggcaucaucacggagaccaucaagagcuggaagaagcagauccuccggacccaggaguccgagugcgucugcgugaacggcagcugcuucaccaucaugacggacgggcccuccaaccgcgccgccagcuaccggaucuucaagaucgagaagggccgcgugaccaaguccaucgagcuggacgccccgaacuaccacuacgaggagugcagcugcuaccccgacaccgggaccgucaugugcgugugccgggacaacuggcacggcuccaaccgccccugggugagcuucaaccagaaccuggacuaccagaucggguacaucugcuccggcgucuucggcgacaacccccggccgaaggacggggagggcagcugcaaccccgugacgguggacggggcggacggcgucaagggguucuccuaccgcuacggcaacggcguguggaucgggcggaccaagagcaaccgccuccggaagggcuucgagaugaucugggaccccaacggguggaccgacaccgacuccgacuucagcaugaagcaggacguggucgccaugaacgacugguccggcuacagcggguccuucgugcagcaccccgagcugacgggccuggacugcaugcgcccgugcuucuggguggagcucguccggggccugccccgcgagaacaccaccaucuggaccagcgggagcuccaucagcuucugcggcgugaacuccgagacggccaacuggagcuggcccgacggggccgagcugcccuucaccaucgacaaguga

SEQ ID NO: 75176 - RNA, 1410 nt, Artificial Sequence
  derived and/or modified sequence opt1 from neuraminidase__InfluenzaA__AAX56543
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccuccggcgacaucugggugacccgggagcccuacgugagcugcgaccccgacaagugcuaccaguucgcccuggggcagggcaccacgcugaacaacgggcacuccaacgacaccguccacgaccgcaccccguaccggacccuccugaugaacgagcugggcgugcccuuccaccucggcacgaagcaggucugcaucgccuggagcuccagcuccugccacgacgggaaggcguggcugcacgugugcgugaccggcgacgacgagaacgccaccgccagcuucaucuacaacgggcgccugguggacuccaucggcagcugguccaagaagauccuccggacccaggagagcgagugcgucugcaucaacgggacgugcaccguggugaugaccgacggcuccgccagcggcaaggcggacaccaagauccuguucaucgaggaggggaagaucguccacacgagcucccugagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccucgugggggacacgccccgcaagaacgacagcuccagcuccagccacugccuggaccccaacaacgaggagggcgggcacggcgucaaggggugggccuucgacgacggcaacgacguguggaugggccggaccaucuccgaggagcugcgcagcggguacgagaccuucaaggucaucgagggcugguccaagcccaacagcaagcuccagaucaaccgccaggugaucguggaccgggggaaccgguccggcuacagcgggaucuucagcgucgagggcaaguccugcaucaaccgcugcuucuacguggagcugauccggggccgcaagcaggagaccgaggugcuguggaccagcaacuccaucgucguguucugcgggaccagcggcaccuacgggacgggcuccuggccggacggggccgacaucaaccucaugcccaucuga

SEQ ID NO: 75177 - RNA, 1410 nt, Artificial Sequence; identical to SEQ ID NO: 75069
  derived and/or modified sequence opt1 from neuraminidase__InfluenzaA__AAX56553

SEQ ID NO: 75178 - RNA, 1410 nt, Artificial Sequence
  derived and/or modified sequence opt1 from neuraminidase__InfluenzaA__AAX56563
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcgcccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcgggacaaccgcagcggcuacuccgggaucuucagcgucgagggcaaguccugcaucaaccggugcuucuacguggagcugauccgcggccggaaggaggagaccgaggugugguggaccagcaacagcaucgucguguucugcgggacguccggcaccuacgggaccggcagcuggccggacggggcggacaucaaccugaugcccaucuga

SEQ ID NO: 75179 - RNA, 1410 nt, Artificial Sequence
  derived and/or modified sequence opt1 from neuraminidase__InfluenzaA__AAX56573
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 75180 - RNA, 1410 nt, Artificial Sequence
  derived and/or modified sequence opt1 from neuraminidase__InfluenzaA__AAX56583
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggaccacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 75181 - RNA, 1410 nt, Artificial Sequence
  derived and/or modified sequence opt1 from neuraminidase__InfluenzaA__AAX56593
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucgucaacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaaguuccgguccggcuacgagaccuucaaggucaucgagggguggagcaagcccaacuccaagcugcagaucaaccgccaggugaucguggagcggggcaaccgcagcggguacuccggcaucuucagcgucgagggcaaguccugcaucaaccggugcuucuacguggagcucauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 75182 - RNA, 1410 nt, Artificial Sequence
  derived and/or modified sequence opt1 from neuraminidase__InfluenzaA__AAX56603
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacggcgcacgaccgcaccccguaccggacccuccugaugaacgagcugggcguccccuuccaccucgggacccgccaggugugcaucgccugguccagcuccagcugccacgacggcaaggccuggcugcacgugugcgucacgggggacgacaagaacgccaccgcguccuucaucuacaacggccggcugguggacagcaucggguccuggagcaagaagauccuccgcacccaggaguccgagugcgugugcaucaacgggaccugcacggucgugaugaccgacggcagcgccuccgggaaggccgacaccaagauccuguucaucgaggagggcaagaucgugcacaucagcacccugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuucuccagcucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggucaucguggagcggggcaaccgcagcggguacuccggcaucuucagcguggagggcaaguccugcaucaaccggugcuucuacgucgagcugauccgcgggcggaaggaggagaccgaggugugguggacgagcaacagcaucguggucuucugcggcaccuccgggaccuacggcaccgggagcuggccggacggcgcggacaucaaccugaugcccaucuga

SEQ ID NO: 75183 - RNA, 1410 nt, Artificial Sequence; identical to SEQ ID NO: 75153
  derived and/or modified sequence opt1 from neuraminidase__InfluenzaA__AAX57647

SEQ ID NO: 75184 - RNA, 1410 nt, Artificial Sequence; identical to SEQ ID NO: 75143
  derived and/or modified sequence opt1 from neuraminidase__InfluenzaA__AAX57657

SEQ ID NO: 75185 - RNA, 1410 nt, Artificial Sequence; identical to SEQ ID NO: 75181
  derived and/or modified sequence opt1 from neuraminidase__InfluenzaA__AAX57667

SEQ ID NO: 75186 - RNA, 1410 nt, Artificial Sequence; identical to SEQ ID NO: 75162
  derived and/or modified sequence opt1 from neuraminidase__InfluenzaA__AAX57677

SEQ ID NO: 75187 - RNA, 1410 nt, Artificial Sequence
  derived and/or modified sequence opt1 from neuraminidase__InfluenzaA__AAX57687
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacgacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucgucaacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 75188 - RNA, 1410 nt, Artificial Sequence
  derived and/or modified sequence opt1 from neuraminidase__InfluenzaA__AAX57697
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggaccacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75189 - RNA, 1410 nt, Artificial Sequence
  derived and/or modified sequence opt1 from neuraminidase__InfluenzaA__AAX57707
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgaccgcuucagcuccagccacugccuggaccccaacaacgaggagggcggccacggggucaagggcugggccuucgacgacggcaacgacguguggauggggcggaccaucuccgagaagcugcgcagcggcuacgagaccuucaaggucaucgaggggugguccaagcccaacagcaagcuccagaucaaccgccaggugaucguggagcggggcaaccgguccggguacagcggcaucuucuccgucgagggcaagagcugcaucaaccgcugcuucuacguggagcugauccgggggcgcaaggaggagaccgaggugugguggacguccaacagcaucgucguguucugcggcaccagcgggaccuacggcaccggguccuggccggacggcgccgacaucaaccugaugcccaucuga

SEQ ID NO: 75190 - RNA, 1410 nt, Artificial Sequence; identical to SEQ ID NO: 75162
  derived and/or modified sequence opt1 from neuraminidase__InfluenzaA__AAX57717

SEQ ID NO: 75191 - RNA, 1410 nt, Artificial Sequence; identical to SEQ ID NO: 75181
  derived and/or modified sequence opt1 from neuraminidase__InfluenzaA__AAX57726

SEQ ID NO: 75192 - RNA, 1410 nt, Artificial Sequence; identical to SEQ ID NO: 75181
  derived and/or modified sequence opt1 from neuraminidase__InfluenzaA__AAX57737

SEQ ID NO: 75193 - RNA, 1410 nt, Artificial Sequence; identical to SEQ ID NO: 75069
  derived and/or modified sequence opt1 from neuraminidase__InfluenzaA__AAX57747

SEQ ID NO: 75194 - RNA, 1410 nt, Artificial Sequence; identical to SEQ ID NO: 75069
  derived and/or modified sequence opt1 from neuraminidase__InfluenzaA__AAX57757

SEQ ID NO: 75195 - RNA, 1410 nt, Artificial Sequence
  derived and/or modified sequence opt1 from neuraminidase__InfluenzaA__AAX57767
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaacaucaccggguucgcccccuucuccaaggacaacagcauccgccucuccgccggcggggacaucugggugacccgggagcccuacgugagcugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgaagcaggucugcaucgccuggagcuccagcuccugccacgacggcaaggcguggcugcacgugugcgugaccggggacgacgagaacgccaccgccagcuucaucuacaacggccgccugguggacuccaucgggagcugguccaagaagauccuccggacccaggagagcgagugcgucugcaucaacggcacgugcaccguggugaugaccgacggcuccgccagcgggaaggcggacaccaagauccuguucaucgaggagggcaagaucguccacacgucccugcucagcgggagcgcccagcacguggaggagugcuccugcuacccccgcuacccgggcgugcggugcgucugccgcgacaacuggaagggcagcaaccggcccaucguggacaucaacgugaaggacuacuccaucgucagcuccuacgugugcagcgggcuggugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcuccgcuccggcuacgagaccuucaaggucaucgagggguggagcaagccgaacuccaagcugcagaucaaccgccaggugaucguggaccggggcaaccggagcggguacuccggcaucuucagcgucgagggcaaguccugcaucaaccgcugcuucuacguggagcugauccgggggcgcaagcaggagaccgaggugcucuggaccagcaacagcaucgucguguucugcggcaccuccgggaccuacggcacggggagcuggcccgacggcgccgacaucaaccugaugcccaucuga

SEQ ID NO: 75196 - RNA, 1410 nt, Artificial Sequence
  derived and/or modified sequence opt1 from neuraminidase__InfluenzaA__AAX57777
augaaccccaaccagaagaucaucaccaucggcagcgugucccugaucaucgccaccaucugcuuccucaugcagaucgccauccuggucacgaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggaccaagcaggucugcaucgccugguccagcuccagcugccacgacggcaaggcguggcugcacgugugcgugacgggggacgacgagaacgccaccgccuccuucaucuacaacggccgccugguggacagcaucggguccuggagcaagaagauccuccggacccaggaguccgagugcgucugcaucaacgggaccugcacgguggugaugaccgacggcagcgccuccgggaaggcggacaccaagauccuguucaucgaggagggcaagaucguccacaccagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagggcaagagcugcaucaaccgcugcuucuacguggagcugauccgggggcgcaagcaggagaccgaggugcuguggacguccaacagcaucgucguguucugcggcaccuccgggaccuacggcaccgggagcuggccggacggcgccgacaucaaccucaugcccaucuga

SEQ ID NO: 75197 - RNA, 1410 nt, Artificial Sequence
  derived and/or modified sequence opt1 from neuraminidase__InfluenzaA__AAX57787
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccaacaccaagauccuguucaucgaggagggcaagaucgucaacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaaguuccgguccggcuacgagaccuucaaggucaucgagggguggagcaagcccaacuccaagcugcagaucaaccgccaggugaucguggagcggggcaaccgcagcggguacuccggcaucuucagcgucgagggcaaguccugcaucaaccggugcuucuacguggagcucauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 75198 - RNA, 1410 nt, Artificial Sequence; identical to SEQ ID NO: 75069
  derived and/or modified sequence opt1 from neuraminidase__InfluenzaA__AAX57797

SEQ ID NO: 75199 - RNA, 1410 nt, Artificial Sequence; identical to SEQ ID NO: 75069
  derived and/or modified sequence opt1 from neuraminidase__InfluenzaA__AAX57807

SEQ ID NO: 75200 - RNA, 1410 nt, Artificial Sequence
  derived and/or modified sequence opt1 from neuraminidase__InfluenzaA__AAX57817
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucuccagcugguccaagaagauccuccggacccaggagagcgagugcgucugcaucaacgggacgugcaccguggugaugaccgacggcuccgccagcggcaaggcggacaccaagauccuguucaucgaggaggggaagaucguccacacgagcucccugagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccucgugggggacacgccccgcaagaacgacagcuccagcuccagccacugccuggaccccaacaacgaggagggcgggcacggcgucaaggggugggccuucgacgacggcaacgacguguggaugggccggaccaucuccgagaagcugcgcagcggguacgagaccuucaaggucaucgagggcugguccaagcccaacagcaagcuccagaucaaccgccaggugaucguggaccgggggaaccgguccggcuacagcgggaucuucagcgucgagggcaaguccugcaucaaccgcugcuucuacguggagcugauccggggccgcaagcaggagaccgaggugcuguggaccagcaacuccaucgucguguucugcgggaccagcggcaccuacgggacgggcuccuggccggacggggccgacaucaaccucaugcccaucuga

SEQ ID NO: 75201 - RNA, 1410 nt, Artificial Sequence; identical to SEQ ID NO: 75069
  derived and/or modified sequence opt1 from neuraminidase__InfluenzaA__AAX57837

SEQ ID NO: 75202 - RNA, 1410 nt, Artificial Sequence
  derived and/or modified sequence opt1 from neuraminidase__InfluenzaA__AAX57847
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagagcaagagcugcaucaaccgcugcuucuacguggagcugauccggggccgcaagcaggagaccgaggugcucuggaccuccaacagcaucgucguguucugcgggaccuccggcaccuacgggacgggcagcuggccggacggggccgacaucaaccugaugcccaucuga

SEQ ID NO: 75203 - RNA, 1410 nt, Artificial Sequence
  derived and/or modified sequence opt1 from neuraminidase__InfluenzaA__AAX57857
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaccaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggaccaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacgcaggaguccgagugcgucugcaucaacgggaccugcaccguggugaugaccgacggcagcgccuccgggaaggcggacacgaagauccuguucaucgaggagggcaagaucguccacaccagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagggcaagagcugcaucaaccgcugcuucuacguggagcugauccgggggcgcaagcaggagaccgaggugcuguggaccuccaacagcaucgucguguucugcggcaccuccgggacguacggcaccgggagcuggccggacggcgccgacaucaaccucaugcccaucuga

SEQ ID NO: 75204 - RNA, 1410 nt, Artificial Sequence; identical to SEQ ID NO: 75069
  derived and/or modified sequence opt1 from neuraminidase__InfluenzaA__AAX57867

SEQ ID NO: 75205 - RNA, 1410 nt, Artificial Sequence
  derived and/or modified sequence opt1 from neuraminidase__InfluenzaA__AAX57877
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagggcaagagcugcaucaaccgcugcuucuacguggagcugauccgggggcgcaagcaggagaccgaggugcuguggaccuccaacagcaucgucguguucugcggcaccuccgggaccuacggcacggggagcuggccggacggcgccgacaucaaccucaugcacaucuga

SEQ ID NO: 75206 - RNA, 1410 nt, Artificial Sequence; identical to SEQ ID NO: 75069
  derived and/or modified sequence opt1 from neuraminidase__InfluenzaA__AAX57887

SEQ ID NO: 75207 - RNA, 1410 nt, Artificial Sequence
  derived and/or modified sequence opt1 from neuraminidase__InfluenzaA__AAX57897
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacagcggcaacgacguguggauggggcggaccaucuccgagaagcugcgcagcggcuacgagaccuucaaggucaucgaggggugguccaagcccaacagcaagcuccagaucaaccgccaggugaucguggaccggggcaaccgguccggguacagcggcaucuucagcgucgagggcaaguccugcaucaaccgcugcuucuacguggagcugauccgggggcgcaagcaggagaccgaggugcuguggaccagcaacuccaucgucguguucugcggcaccagcgggaccuacggcacgggguccuggccggacggcgccgacaucaaccucaugcccaucuga

SEQ ID NO: 75208 - RNA, 1410 nt, Artificial Sequence
  derived and/or modified sequence opt1 from neuraminidase__InfluenzaA__AAX57907
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaugaaccgccaggugaucguggaccggggcaaccggagcggguacuccggcaucuucagcgucgagggcaagagcugcaucaaccgcugcuucuacguggagcugauccgggggcgcaagcaggagaccgaggugcuguggaccuccaacagcaucgucguguucugcggcaccuccgggaccuacggcacggggagcuggccggacggcgccgacaucaaccucaugcccaucuga

SEQ ID NO: 75209 - RNA, 1410 nt, Artificial Sequence; identical to SEQ ID NO: 75069
  derived and/or modified sequence opt1 from neuraminidase__InfluenzaA__AAX57917

SEQ ID NO: 75210 - RNA, 1410 nt, Artificial Sequence; identical to SEQ ID NO: 75069
  derived and/or modified sequence opt1 from neuraminidase__InfluenzaA__AAX57927

SEQ ID NO: 75211 - RNA, 1410 nt, Artificial Sequence
  derived and/or modified sequence opt1 from neuraminidase__InfluenzaA__AAX57937
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagauggucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcaccagcgggaccuacggcacgggguccuggccggacggcgccgacaucaaccugaugcggaucuga

SEQ ID NO: 75212 - RNA, 1410 nt, Artificial Sequence
  derived and/or modified sequence opt1 from neuraminidase__InfluenzaA__AAX57947
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagccgcaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgccuccagcuacaugugcuccgggcucgucggcgacacgccccgcaagaacgacagcuucuccagcucccacugccuggaccccaacaacgaggagggcgggcacggggugaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucgucgagcggggcaaccggagcggguacuccggcaucuucagcguggagggcaaguccugcaucaaccgcugcuucuacguggagcugauccgggggcgcaaggaggagaccgaggucugguggaccagcaacagcaucgugguguucugcggcaccuccgggaccuacggcacggggagcuggccggacggcgccgacaucaaccugaugcccaucuga

SEQ ID NO: 75213 - RNA, 1410 nt, Artificial Sequence; identical to SEQ ID NO: 75153
  derived and/or modified sequence opt1 from neuraminidase__InfluenzaA__AAX76626

SEQ ID NO: 75214 - RNA, 1410 nt, Artificial Sequence
  derived and/or modified sequence opt1 from neuraminidase__InfluenzaA__AAX76646
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacaacaccguccacgaccgcaccccguaccggacccuccugaugaacgagcugggcgugcccuuccaccucgggacgcgccaggugugcaucgccugguccagcuccggcugccacgacgggaaggcguggcugcacgucugcgugaccggcgacgacaagaacgccaccgccagcuucaucuacaacgggcggcugguggacuccaucggcagcugguccaagaagauccuccgcacccaggagagcgagugcgucugcaucaacggcacgugcaccguggugaugaccgacggguccgccagcggcaaggcggacaccaagauccuguucaucgaggaggggaagaucguccacaucuccacgcugagcggcagcgcccagcacguggaggagugcuccugcuacccccgguaccccggcgugcgcugcgucugccgggacaacuggaaggggagcaaccgcccgaucguggacaucaacgugaaggacuacuccaucgucagcuccuacgugugcagcggccucgugggggacacgccccggaagaacgacuccuucagcuccagccacugccuggaccccaacaacgaggagggcgggcacggcgucaagggcugggccuucgacgacgggaacgacguguggaugggccgcaccaucuccgagaagcugcggagcggguacgagaccuucaaggucaucgagggcugguccaagcccaacagcaagcuccagaucaaccgccaggugaucguggagcgggggaaccgcuccggcuacagcggcaucuucuccgucgagggcaagagcugcaucaaccggugcuucuacguggagcugauccgcgggcggaaggaggagaccgaggugugguggaccuccaacagcaucgucguguucugcgggaccagcggcaccuacgggacgggcuccuggccggacggcgccgacaucaaccugaugcccaucuga

SEQ ID NO: 75215 - RNA, 1410 nt, Artificial Sequence; identical to SEQ ID NO: 75143
  derived and/or modified sequence opt1 from neuraminidase__InfluenzaA__AAX76656

SEQ ID NO: 75216 - RNA, 1410 nt, Artificial Sequence; identical to SEQ ID NO: 75188
  derived and/or modified sequence opt1 from neuraminidase__InfluenzaA__AAX76666

SEQ ID NO: 75217 - RNA, 1410 nt, Artificial Sequence; identical to SEQ ID NO: 75069
  derived and/or modified sequence opt1 from neuraminidase__InfluenzaA__AAX76696

SEQ ID NO: 75218 - RNA, 1410 nt, Artificial Sequence
  derived and/or modified sequence opt1 from neuraminidase__InfluenzaA__AAX76736
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuguccgaguaccggaacuggagcaagccgcagugcaacaucaccggguucgcgcccuucuccaaggacaacagcauccgccucuccgccggcggggacaucugggugacccgggagcccuacgugagcugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggagcuccagcuccugccacgacggcaaggccuggcugcacgugugcgugaccggggacgacgagaacgcgaccgccagcuucaucuacaacggccgccugguggacuccaucgggagcugguccaagaagauccuccggacccaggagagcgagugcgucugcaucaacggcacgugcaccguggugaugaccgacggcuccgccagcgggaaggccgacaccaagauccuguucaucgaggagggcaagaucguccacaucagcacgcugucccgcagcgcgcagcacguggaggagugcuccugcuacccccgguaccccggggugcgcugcgucugccgggacaacuggaagggcagcaaccgcccgaucguggacaucaacgugaaggaccacuccaucgucagcuccuacgugugcagcggccucgugggggacacgccccggaagaacgacuccuucagcuccagccacugccuggaccccaacaacgaggagggcgggcacggcgucaaggggugggccuucgacgacggcaacgacguguggaugggccgcaccaucuccgagaagcugcggagcggguacgagaccuucaaggucaucgagggcugguccaagcccaacagcaagcuccagaucaaccgccaggugaucguggagcgggggaaccgcuccggcuacagcgggaucuucuccgucgagggcaagagcugcaucaaccggugcuucuacguggagcugauccgcggccggaaggaggagaccgaggugugguggaccagcaacuccaucgucguguucugcgggaccagcggcaccuacgggacgggcuccuggccggacggggccgacaucaaccugaugcccaucuga

SEQ ID NO: 75219 - RNA, 1410 nt, Artificial Sequence
  derived and/or modified sequence opt1 from neuraminidase__InfluenzaA__AAX76766
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgugggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggaggagaccgaggucugguggaccagcaacagcaucgugguguucugcggcaccuccgggaccuacggcacggggagcuggccggacggcgccgacaucaaccugaugcccaucuga

SEQ ID NO: 75220 - RNA, 1410 nt, Artificial Sequence; identical to SEQ ID NO: 75145
  derived and/or modified sequence opt1 from neuraminidase__InfluenzaA__AAY18089

SEQ ID NO: 75221 - RNA, 1410 nt, Artificial Sequence
  derived and/or modified sequence opt1 from neuraminidase__InfluenzaA__AAY18099
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacaacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucgucgaggagggcaagaucgugcacaucagcacgcugagcggguccgcccagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggaggagaccgaggucugguggaccagcaacagcaucgugguguucugcggcaccuccgggaccuacggcacggggagcuggccggacggcgccgacaucaaccugaugcccaucuga

SEQ ID NO: 75222 - RNA, 1410 nt, Artificial Sequence
  derived and/or modified sequence opt1 from neuraminidase__InfluenzaA__AAY18109
augaaccccaaccagaagaucaucaccaucggcagcgugucccugaccaucgccacgaucugcuuccucaugcagaucgccauccuggucaccacccugacccuccacuucaagcaguacgagugcaacagcccgcccaacaaccaggugaugcugugcgagcccgcgaucaucgagcgcaacaucacggagaucguguaccugaccaacaccaccaucgagaaggagaagugccccaagcucgccgaguaccggaacugguccaagccgcagugcaacaucacgggguucgcccccuucagcaaggacaacuccauccgccugagcgccggcggggacaucugggucacccgggagcccuacguguccugcgaccccgacaagugcuaccaguucgcccugggccaggggaccacccucaacaacggccacagcaacgacacggugcacgaccgcaccccguaccggacccugcugaugaacgagcucggcguccccuuccaccuggggacccgccaggugugcaucgcgugguccagcuccagcugccacgacggcaaggccuggcugcacgugugcgucacgggggacgacgagaacgccaccgccuccuucaucuacaacggccggcucguggacagcaucggguccuggagcaagaagauccugcgcacccaggaguccgagugcgugugcaucaacgggaccugcacggucgugaugaccgacggcagcgcguccgggaaggccgacaccaagauccuguucaucgaggagggcaagaucgugaacaucagcacccucagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcuggugggcgacacgccccggaagaacgacagcuucuccagcucccacugccuggaccccaacaacgaggagggcggccacggggugaagggcugggccuucgacgacggcaacgacgucuggauggggcgcaccaucagcgagaagcuccgguccggcuacgagaccuucaaggugaucgagggguggagcaagcccaacuccaagcugcagaucaaccgccaggucaucguggagcggggcaaccgcagcggguacuccggcaucuucagcguggagggcaaguccugcaucaaccggugcuucuacgucgagcugauccgcgggcggaaggaggagaccgaggugugguggacgagcaacagcaucguggucuucugcggcaccuccgggaccuacggcaccgggagcuggccggacggcgccgacaucaaccucaugcccaucuga

SEQ ID NO: 75223 - RNA, 1410 nt, Artificial Sequence; identical to SEQ ID NO: 75181
  derived and/or modified sequence opt1 from neuraminidase__InfluenzaA__AAY18119

SEQ ID NO: 75224 - RNA, 1410 nt, Artificial Sequence
  derived and/or modified sequence opt1 from neuraminidase__InfluenzaA__AAY18129
augaaccccaaccagaagaucaucaccaucggcagcgugucccugaccaucgccacgaucugcuuccucaugcagaucaccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggccgaguaccggaacugguccaagccgcagugcaacaucaccggguucgcgcccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggacccgccaggugugcaucgccugguccagcuccagcugccacgacggcaaggccuggcugcacgucugcgugaccggggacgacaagaacgcgaccgccuccuucaucuacaacggccggcugguggacagcaucggguccuggagcaagaagauccuccgcacgcaggaguccgagugcgucugcaucaacgggaccugcaccguggugaugaccgacggcagcgccuccgggaaggccgacacgaagauccuguucaucgaggagggcaagaucauccacaucagcacccugagcggguccgcgcagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuccagcuccagccacugccuggaccccaacaacgaggagggcggccacggggugaagggcugggccuucgacgacggcaacgacgucuggauggggcgcaccaucuccgagaagcugcggagcggcuacgagaccuucaaggugaucgaggggugguccaagagcaacuccaagcuccagaucaaccgccaggucaucguggagcggggcaaccgcagcggguacuccggcaucuucagcguggagggcaagagcugcaucaaccggugcuucuacgucgagcugauccgcgggcggaaggaggagaccgaggugugguggaccuccaacagcaucguggucuucugcggcaccuccgggacguacggcaccgggagcuggcccgacggcgccgacaucaaccugaugccgaucuga

SEQ ID NO: 75225 - RNA, 1410 nt, Artificial Sequence
  derived and/or modified sequence opt1 from neuraminidase__InfluenzaA__AAY18139
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagcgggagaucugccccaagcuggcggaguaccgcaacugguccaagccgcagugcaacaucaccggguucgcccccuucagcaaggacaacuccauccggcucagcgccggcggggacaucugggugacccgcgagcccuacguguccugcgaccccgacaagugcuaccaguucgcccugggccaggggaccacgcugaacaaccggcacagcaacgacaccguccacgaccgcaccccguaccggacccuccugaugaacgagcugggcgugcccuuccaccucggcacgcgccaggugugcaucgccugguccagcuccagcugccacgacgggaaggcguggcugcacgucugcgugaccggcgacgacaagaacgccaccgccuccuucaucuacaacgggcggcugguggacagcaucggcuccuggagcaagaagauccuccgcacccaggaguccgagugcgucugcaucaacgggacgugcaccguggugaugaccgacggcagcgccuccggcaaggcggacaccaagauccuguucaucgaggaggggaagaucguccacaucagcacgcugagcggcuccgcccagcacguggaggagugcagcugcuacccccgguaccccggggugcgcugcgucugccgggacaacuggaagggcuccaaccgcccgaucguggacaucaacgugaaggacuacagcaucgucuccagcuacgugugcuccggccucgugggggacacgccccggaagaacgacagcuccagcuccagccacugccuggaccccaacaacgaggagggcgggcacggcgucaaggggugggccuucgacgacggcaacgacguguggaugggccgcaccaucuccgagaagcugcggagcggguacgagaccuucaaggucaucgagggcugguccaagcccaacagcaagcuccagaucaaccgccaggugaucguggagcgggggaaccgcuccggcuacagcgggaucuucuccgucgagggcaagagcugcaucaaccggugcuucuacguggagcugauccgcggccgcaaggaggagaccgaggugugguggaccagcaacuccaucgucguguucugcgggaccagcggcaccuacgggacgggcuccuggccggacggggccgacaucaaccugaugcccaucuga

SEQ ID NO: 75226 - RNA, 1410 nt, Artificial Sequence
  derived and/or modified sequence opt1 from neuraminidase__InfluenzaA__AAY18149
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaccguggacaucaacgugaaggacuacagcaucgucuccagcuacgugugcuccgggcucgugggcgacacgccccggaagaacgacagcuccagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccagcaacuccaucgucguguucugcggcaccagcgggacguacggcaccggguccuggccggacggcgccgacaucaaccugaugcccaucuga

SEQ ID NO: 75227 - RNA, 1410 nt, Artificial Sequence
  derived and/or modified sequence opt1 from neuraminidase__InfluenzaA__AAY18159
augaaccccaaccagaagaucaucaccaucggcagcgugucccugaucaucgccaccaucugcuuccucaugcagaucgccauccuggucacgaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggaccaagcaggucugcaucgccugguccagcuccagcugccacgacggcaaggcguggcugcacgugugcgugacgggggacgacgagaacgccaccgccuccuucaucuacaacggccgccugguggacagcaucggguccuggagcaagaagauccuccggacccaggaguccgagugcgucugcaucaacgggaccugcacgguggugaugaccgacggcagcgccuccgggaaggcggacaccaagauccuguucaucgaggagggcaagaucguccacaccagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagggcaagaacugcaucaaccgcugcuucuacguggagcugauccgggggcgcaagcaggagaccgaggugcuguggacgagcaacuccaucgucguguucugcggcaccagcgggaccuacggcaccggguccuggccggacggcgccgacaucaaccucaugcccaucuga

SEQ ID NO: 75228 - RNA, 1410 nt, Artificial Sequence; identical to SEQ ID NO: 75069
  derived and/or modified sequence opt1 from neuraminidase__InfluenzaA__AAY18179

SEQ ID NO: 75229 - RNA, 1410 nt, Artificial Sequence; identical to SEQ ID NO: 75069
  derived and/or modified sequence opt1 from neuraminidase__InfluenzaA__AAY18189

SEQ ID NO: 75230 - RNA, 1410 nt, Artificial Sequence
  derived and/or modified sequence opt1 from neuraminidase__InfluenzaA__AAY18199
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcagggggucaagggcugggccuucgacgacgggaacgacguguggaugggccggaccaucagcgagaagcugcacuccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaagcaggagaccgaggugcuguggaccuccaacagcaucgucguguucugcggcaccuccgggacguacggcaccgggagcuggccggacggcgccgacaucaaccugaugcccaucuga

SEQ ID NO: 75231 - RNA, 1410 nt, Artificial Sequence; identical to SEQ ID NO: 75172
  derived and/or modified sequence opt1 from neuraminidase__InfluenzaA__AAY18588

SEQ ID NO: 75232 - RNA, 1410 nt, Artificial Sequence; identical to SEQ ID NO: 75153
  derived and/or modified sequence opt1 from neuraminidase__InfluenzaA__AAY18614

SEQ ID NO: 75233 - RNA, 1410 nt, Artificial Sequence
  derived and/or modified sequence opt1 from neuraminidase__InfluenzaA__AAY27846
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 75234 - RNA, 1410 nt, Artificial Sequence
  derived and/or modified sequence opt1 from neuraminidase__InfluenzaA__AAY27856
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaacggccacagcaacgacaccguccacgaccgcaccccguaccggacccuccugaugaacgagcugggggugcccuuccaccucggcacgcgccaggugugcaucgccugguccagcuccagcugccacgacgggaaggcguggcugcacgucugcgugaccggcgacgacaagaacgccaccgccuccuucaucuacaacgggcggcugguggacagcaucggcuccuggagcaagaagauccuccgcacccaggaguccgagugcgucugcaucaacggcacgugcaccguggugaugaccgacgggagcgccuccggcaaggcggacaccaagauccuguucaucgaggaggggaagaucguccacaucagcacgcugagcggcuccgcccagcacguggaggagugcagcugcuacccccgguaccccggcgugcgcugcgucugccgggacaacuggaagggguccaaccgcccgaucguggacaucaacgugaaggacuacagcaucgucuccagcuacgugugcuccggccucgugggggacacgccccggaagaacgacagcuccagcuccagccacugccuggaccccaacaacgaggagggcgggcacggcgucaagggcugggccuucgacgacgggaacgacguguggaugggccgcaccaucuccgagaagcugcggagcggguacgagaccuucaaggucaucgagggcugguccaagcccaacagcaagcuccagaucaaccgccaggugaucguggagcgggggaaccgcuccggcuacagcggcaucuucuccgucgagggcaagagcugcaucaaccggugcuucuacguggagcugauccgcgggcggaaggaggagaccgaggugugguggaccagcaacuccaucgucguguucugcgggaccagcggcaccuacgggacgggcuccuggccggacggcgccgacaucaaccugaugcccaucuga

SEQ ID NO: 75235 - RNA, 1410 nt, Artificial Sequence; identical to SEQ ID NO: 75145
  derived and/or modified sequence opt1 from neuraminidase__InfluenzaA__AAY27866

SEQ ID NO: 75236 - RNA, 1410 nt, Artificial Sequence
  derived and/or modified sequence opt1 from neuraminidase__InfluenzaA__AAY27962
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacaacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 75237 - RNA, 1410 nt, Artificial Sequence
  derived and/or modified sequence opt1 from neuraminidase__InfluenzaA__AAY27997
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacaacaccguccacgaccgcaccccguaccggacccuccugaugaacgagaugggcgugcccuuccaccuggggacgcgccaggugugcaucgccugguccagcuccagcugccacgacggcaaggcguggcuccacgucugcgugaccggggacgacaagaacgccaccgccuccuucaucuacaacggccggcugguggacagcaucggguccuggagcaagaagauccugcgcacccaggaguccgagugcgucugcaucaacggcacgugcaccguggugaugaccgacggcagcgccuccgggaaggcggacaccaagauccucuucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcuggugggcgacacgccccggaagaacgacagcuucuccagcucccacugccucgaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcugcagaucaaccgccaggugaucguggagcggggcaaccgcagcggguacuccggcaucuucagcgucgagggcaaguccugcaucaaccggugcuucuacguggagcucauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75238 - RNA, 1410 nt, Artificial Sequence; identical to SEQ ID NO: 75143
  derived and/or modified sequence opt1 from neuraminidase__InfluenzaA__AAY28007

SEQ ID NO: 75239 - RNA, 1410 nt, Artificial Sequence; identical to SEQ ID NO: 75188
  derived and/or modified sequence opt1 from neuraminidase__InfluenzaA__AAY28017

SEQ ID NO: 75240 - RNA, 1410 nt, Artificial Sequence; identical to SEQ ID NO: 75143
  derived and/or modified sequence opt1 from neuraminidase__InfluenzaA__AAY28268

SEQ ID NO: 75241 - RNA, 1410 nt, Artificial Sequence
  derived and/or modified sequence opt1 from neuraminidase__InfluenzaA__AAY28278
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacacgagcaagcugagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccucgugggggacacgccccgcaagaacgacagcuccagcuccagccacugccuggaccccaacaacgaggagggcgggcacggcgucaaggggugggccuucgacgacggcaacgacguguggaugggccggaccaucuccgagaagucccgcagcggguacgagaccuucaaggucaucgagggcuggagcaagcccaacuccaagcugcagaucaaccgccaggugaucguggagcgggggaaccggagcggcuacuccgggaucuucagcgucgagggcaagagcugcaucaaccgcugcuucuacguggagcucauccggggccgcaagccggagaccgaggugugguggaccuccaacagcaucgucguguucugcgggaccuccggcaccuacgggacgggcagcuggcccgacggggccgacaucaaccugaugcccaucuga

SEQ ID NO: 75242 - RNA, 1410 nt, Artificial Sequence; identical to SEQ ID NO: 75157
  derived and/or modified sequence opt1 from neuraminidase__InfluenzaA__AAY28288

SEQ ID NO: 75243 - RNA, 1410 nt, Artificial Sequence
  derived and/or modified sequence opt1 from neuraminidase__InfluenzaA__AAY28298
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuccagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgagggguggucccgccccaacagcaagcuccagaucaaccgccaggugaucguggagcggggcaaccgguccggguacagcggcaucuucuccgucgagggcaagagcugcaucaaccgcugcuucuacguggagcugauccgggggcgcaaggaggagaccgaggugugguggaccagcaacuccaucgucguguucugcggcaccagcgggaccuacggcacgggguccuggccggacggcgccgacaucaaccugaugcccaucuga

SEQ ID NO: 75244 - RNA, 1410 nt, Artificial Sequence; identical to SEQ ID NO: 75174
  derived and/or modified sequence opt1 from neuraminidase__InfluenzaA__AAY28308

SEQ ID NO: 75245 - RNA, 1410 nt, Artificial Sequence
  derived and/or modified sequence opt1 from neuraminidase__InfluenzaA__AAY28318
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcgccguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaccaaccgccaggugaucguggagcggggcaaccgcagcggguacuccggcaucuucagcgucgagggcaaguccugcaucaaccggugcuucuacguggagcugauccgcgggcggaaggaggagacggaggugugguggaccagcaacagcaucgucguguucugcggcaccuccgggaccuacggcacggggagcuggccggacggcgccgacaucaaccugaugcccaucuga

SEQ ID NO: 75246 - RNA, 1410 nt, Artificial Sequence
  derived and/or modified sequence opt1 from neuraminidase__InfluenzaA__AAY28338
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagauccggcccaagcuggccgaguaccgcaacugguccaagccgcagugcaacaucacgggguucgcccccuucagcaaggacaacuccauccggcucagcgccggcggggacaucugggugacccgcgagcccuacguguccugcgaccccgacaagugcuaccaguucgcccugggccaggggaccacccugaacaacggccacagcaacgacacgguccacgaccggaccccguaccgcacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacaacggccggcugguggacagcaucggguccuggagcaagaagauccuccggacccaggaguccgagugcgucugcaucaacgggaccugcacgguggugaugaccgacggcagcgcguccgggaaggccgacaccaagauccuguucaucgaggagggcaagaucgucaacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggacgagcaacagcaucgucguguucugcggcaccuccgggaccuacggcaccgggagcuggccggacggcgccgacaucaaccugaugcccaucuga

SEQ ID NO: 75247 - RNA, 1410 nt, Artificial Sequence; identical to SEQ ID NO: 75153
  derived and/or modified sequence opt1 from neuraminidase__InfluenzaA__AAY28348

SEQ ID NO: 75248 - RNA, 1410 nt, Artificial Sequence; identical to SEQ ID NO: 75069
  derived and/or modified sequence opt1 from neuraminidase__InfluenzaA__AAY28358

SEQ ID NO: 75249 - RNA, 1410 nt, Artificial Sequence; identical to SEQ ID NO: 75153
  derived and/or modified sequence opt1 from neuraminidase__InfluenzaA__AAY28388

SEQ ID NO: 75250 - RNA, 1410 nt, Artificial Sequence; identical to SEQ ID NO: 75158
  derived and/or modified sequence opt1 from neuraminidase__InfluenzaA__AAY28398

SEQ ID NO: 75251 - RNA, 1410 nt, Artificial Sequence; identical to SEQ ID NO: 75172
  derived and/or modified sequence opt1 from neuraminidase__InfluenzaA__AAY28408

SEQ ID NO: 75252 - RNA, 1410 nt, Artificial Sequence; identical to SEQ ID NO: 75145
  derived and/or modified sequence opt1 from neuraminidase__InfluenzaA__AAY28505

SEQ ID NO: 75253 - RNA, 1410 nt, Artificial Sequence
  derived and/or modified sequence opt1 from neuraminidase__InfluenzaA__AAY28524
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacuacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuccagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccagcaacuccaucgucguguucugcggcaccagcgggaccuacggcacgggguccuggccggacggcgccgacaucaaccugaugcccaucuga

SEQ ID NO: 75254 - RNA, 1410 nt, Artificial Sequence; identical to SEQ ID NO: 75143
  derived and/or modified sequence opt1 from neuraminidase__InfluenzaA__AAY28534

SEQ ID NO: 75255 - RNA, 1410 nt, Artificial Sequence
  derived and/or modified sequence opt1 from neuraminidase__InfluenzaA__AAY28544
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccaacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75256 - RNA, 1410 nt, Artificial Sequence; identical to SEQ ID NO: 75069
  derived and/or modified sequence opt1 from neuraminidase__InfluenzaA__AAY28554

SEQ ID NO: 75257 - RNA, 1410 nt, Artificial Sequence
  derived and/or modified sequence opt1 from neuraminidase__InfluenzaA__AAY28564
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuccagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgagggguggucccgccccaacagcaagcuccagaucaaccgccaggugaucguggagcggggcaaccgguccggguacagcggcaucuucuccgucgagagcaagagcugcaucaaccgcugcuucuacguggagcugauccggggccgcaaggaggagaccgaggugugguggaccuccaacagcaucgucguguucugcgggaccuccggcaccuacgggacgggcagcuggccggacggggccgacaucaaccugaugcccaucuga

SEQ ID NO: 75258 - RNA, 1410 nt, Artificial Sequence; identical to SEQ ID NO: 75143
  derived and/or modified sequence opt1 from neuraminidase__InfluenzaA__AAY28574

SEQ ID NO: 75259 - RNA, 1410 nt, Artificial Sequence; identical to SEQ ID NO: 75157
  derived and/or modified sequence opt1 from neuraminidase__InfluenzaA__AAY28584

SEQ ID NO: 75260 - RNA, 1410 nt, Artificial Sequence; identical to SEQ ID NO: 75069
  derived and/or modified sequence opt1 from neuraminidase__InfluenzaA__AAY28594

SEQ ID NO: 75261 - RNA, 1410 nt, Artificial Sequence
  derived and/or modified sequence opt1 from neuraminidase__InfluenzaA__AAY28611
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagggcaagagcugcaucaaccgcugcuucuacguggagcugauccgggggcgcaagcaggagaccgaggugcuguggaccuccaacagcaucgucguguucugcggcaccuccgggaccuacggcacggggagcuggccggacggcgccgacaucaaccucaugcccaucuga

SEQ ID NO: 75262 - RNA, 1410 nt, Artificial Sequence; identical to SEQ ID NO: 75174
  derived and/or modified sequence opt1 from neuraminidase__InfluenzaA__AAY28651

SEQ ID NO: 75263 - RNA, 1410 nt, Artificial Sequence
  derived and/or modified sequence opt1 from neuraminidase__InfluenzaA__AAY44613
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagaucgcggaguaccggaacugguccaagccgcagugcaacaucaccggguucgcccccuucagcaaggacaacuccauccgccugagcgccggcggggacaucugggugacccgggagcccuacguguccugcgaccccgacaagugcuaccaguucgcccucggccaggggaccacgcugaacaacggccacagcaacgacaccguccacgaccgcaccccguaccggacccugcucaugaacgagcugggcgugcccuuccaccuggggacgcgccaggugugcaucgccugguccagcuccagcugccacgacggcaaggcguggcuccacgucugcgugaccggggacgacaagaacgccaccgccuccuucaucuacaacggccggcugguggacagcaucggguccuggagcaagaagauccugcgcacccaggaguccgagugcgucugcaucaacggcacgugcaccguggugaugaccgacggcagcgccuccgggaaggcggacaccaagauccucuucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcuggugggcgacacgccccggaagaacgacagcuccagcuccagccacugccucgaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcugcagaucaaccgccaggugaucguggagcggggcaaccgcuccggguacagcggcaucuucuccgucgagggcaagagcugcaucaaccggugcuucuacguggagcucauccgcgggcggaaggaggagaccgaggugugguggaccagcaacuccaucgucguguucugcggcaccagcgggaccuacggcacgggguccuggccggacggcgccgacaucaaccugaugcccaucuga

SEQ ID NO: 75264 - RNA, 1410 nt, Artificial Sequence; identical to SEQ ID NO: 75157
  derived and/or modified sequence opt1 from neuraminidase__InfluenzaA__AAY44624

SEQ ID NO: 75265 - RNA, 1410 nt, Artificial Sequence; identical to SEQ ID NO: 75179
  derived and/or modified sequence opt1 from neuraminidase__InfluenzaA__AAY44634

SEQ ID NO: 75266 - RNA, 1410 nt, Artificial Sequence; identical to SEQ ID NO: 75172
  derived and/or modified sequence opt1 from neuraminidase__InfluenzaA__AAY44644

SEQ ID NO: 75267 - RNA, 1410 nt, Artificial Sequence
  derived and/or modified sequence opt1 from neuraminidase__InfluenzaA__AAY44654
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagauccaccgccaggugaucguggaccggggcaaccggagcggguacuccggcaucuucagcgucgagggcaagagcugcaucaaccgcugcuucuacguggagcugauccgggggcgcaagcaggagaccgaggugcuguggaccuccaacagcaucgucguguucugcggcaccuccgggaccuacggcacggggagcuggccggacggcgccgacaucaaccucaugcccaucuga

SEQ ID NO: 75268 - RNA, 1410 nt, Artificial Sequence
  derived and/or modified sequence opt1 from neuraminidase__InfluenzaA__AAY44758
augaaccccaaccagaagaucaucaccaucggcagcgugucccugaccaucgccacgaucugcuuccucaugcagaucgccauccuggucaccaccgugacccugcacuucaagcaguacgagugcaacagcccguccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaagaucaccggguucgccccguucuccaaggacaacagcauccgccucuccgccggcggggacaucugggugacccgggagcccuacgugagcugcgaccccgacaagugcuaccaguucgcccugggccaggggaccacgcugaacaaccgccacuccaacgacaccguccacgaccggacccccuaccgcacccuccugaugaacgagcugggcgugccguuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgccagcggccgggcggacaccaagauccuguucaucgaggaggggaagaucguccacacgagcaagcuguccggcagcgcccagcacguggaggagugcuccugcuacccccgcuaccccggggugcggugcgucugccgcgacaacuggaagggcagcaaccggcccaucguggacaucaacgugaaggacuacuccaucgucagcuccuacgugugcagcggccucgugggggacaccccgcgcaagaacgacuccagcuccagcucccacugccuggaccccaacaacgaggagggcgggcacggcgucaaggggugggccuucgacgacggcaacgacguguggaugggccggaccaucagcgagaagucccgcagcggguacgagaccuucaaggucaucgagggcugguccaagcccaacagcaagcugcagaucaaccgccaggugaucguggagcgggggaaccgguccggcuacagcgggaucuucagcgucgagggcaaguccugcaucaaccgcugcuucuacguggagcucauccggggccgcaagcccgagacggaggugugguggaccagcaacuccaucgucguguucugcgggaccagcggcaccuacgggacgggcuccuggccggacggggccgacaucaaccugaugcccaucuga

SEQ ID NO: 75269 - RNA, 1410 nt, Artificial Sequence; identical to SEQ ID NO: 75069
  derived and/or modified sequence opt1 from neuraminidase__InfluenzaA__AAY44778

SEQ ID NO: 75270 - RNA, 1410 nt, Artificial Sequence
  derived and/or modified sequence opt1 from neuraminidase__InfluenzaA__AAY44788
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaucuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcaccagcgggaccuacggcaccggguccuggccggacggcgccgacaucaaccugaugcccaucuga

SEQ ID NO: 75271 - RNA, 1410 nt, Artificial Sequence; identical to SEQ ID NO: 75145
  derived and/or modified sequence opt1 from neuraminidase__InfluenzaA__AAY44909

SEQ ID NO: 75272 - RNA, 1410 nt, Artificial Sequence; identical to SEQ ID NO: 75172
  derived and/or modified sequence opt1 from neuraminidase__InfluenzaA__AAY45649

SEQ ID NO: 75273 - RNA, 1410 nt, Artificial Sequence
  derived and/or modified sequence opt1 from neuraminidase__InfluenzaA__AAY46374
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccuacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacacgagcaagcugagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccucgugggggacacgccccgcaagaacgacagcuccagcuccagccacugccuggaccccaacaacgaggagggcgggcacggcgucaaggggugggccuucgacgacggcaacgacguguggaugggccggaccaucuccgagaagucccgcagcggguacgagaccuucaaggucaucgagggcuggagcaagcccaacuccaagcugcagaucaaccgccaggugaucguggagcgggggaacaugagcggcuacuccgggaucuucagcgucgagggcaagagcugcaucaaccggugcuucuacguggagcucauccgcggccggaagcaggagaccgaggugugguggaccuccaacagcaucgucguguucugcgggaccuccggcaccuacgggacgggcagcuggccggacggggccgacaucaaccugaugcccaucuga

SEQ ID NO: 75274 - RNA, 1410 nt, Artificial Sequence
  derived and/or modified sequence opt1 from neuraminidase__InfluenzaA__AAY46384
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacgccguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 75275 - RNA, 1410 nt, Artificial Sequence
  derived and/or modified sequence opt1 from neuraminidase__InfluenzaA__AAY46394
augaaccccaaccagaagaucaucaccaucggcagcgugucccugaccaucgccacgaucugcuuccucaugcagaucgccauccugaucaccaccgucacccugcacuucaagcaguacgagugcaacagcccgcccaacaaccaggugaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggucacccgggagcccuacguguccugcgaccccgacaagugcuaccaguucgcccugggccaggggaccacgcugaacaacggccacagcaacgacaccgugcacgaccgcaccccguaccggacccuccugaugaacgagcugggcguccccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgugugcaucaacggcacgugcaccgucgugaugaccgacggcagcgccuccgggaaggcggacaccaagauccuguucaucgaggagggcaagaucgugcacacgagcagccuguccgggagcgcccagcacgucgaggagugcuccugcuacccccgcuaccccggcgugcggugcgugugccgcgacaacuggaagggcagcaaccggccgaucgucgacaucaacgugaaggacuacuccaucgugagcuccuacgucugcagcgggcucgugggcgacacgccccgcaagaacgacuccagcuccagcucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcuccagaucaaccggcaggucaucguggaccgcggcaaccggagcggguacuccggcaucuucagcguggagggcaagagcugcaucaaccgcugcuucuacgucgagcugauccgggggcgcaagcaggagaccgaggugcuguggaccuccaacagcaucguggucuucugcggcaccuccgggaccuacggcacggggagcuggccggacggcgccgacaucgaccucaugcccaucuga

SEQ ID NO: 75276 - RNA, 1410 nt, Artificial Sequence
  derived and/or modified sequence opt1 from neuraminidase__InfluenzaA__AAY46419
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccucggccaggggaccacgcugaacaaccgccacagcaacgacaccguccacgaccggacccccuaccgcacccugcucaugaacgagcugggcgugccguuccaccugggcacgaagcaggucugcaucgccugguccagcuccagcugccacgacgggaaggcguggcuccacgugugcgugaccggccacaacgagaacgccaccgccuccuucaucuacgggggccggcugguggacagcaucggguccuggagcaagaagauccugcgcacccaggaguccgagugcgucugcaucaacggcacgugcaccguggugaugaccgacggcagcgccuccgggcgggcggacaccaagauccucuucaucgaggagggcaagaucauccacaucagccagcugagcggguccgcccagcacgucgaggagugcagcugcuacccccgcuaccccggcgugcggugcgugugccgcgacaacuggaagggcuccaaccggcccaucgucgacaucaacgugaaggacuacagcaucguguccagcuacgucugcuccgggcuggugggcgacacgccgcgcaagaacgacagcuccagcuccagccacugccucaaccccaacaacgaggagggcgggcacggggugaagggcugggccuucgacgacggcaacgacgucuggauggggcggaccaucuccgagaaguuccgcagcggcuacgagaccuucaaggugaucgaggggugguccaagcccaacagcaagcugcagaucaaccggcaggucaucguggaccgcgacaaccgguccggcuacagcgggaucuucuccguggagggcaagagcugcaucaaccgcugcuucuacgucgagcugauccggggccgcaagcaggagaccgaggugugguggacgagcaacuccaucguggucuucugcgggaccagcggcaccuacgggaccggcuccuggcccgacggggccgacaucaaccucaugccgaucuga

SEQ ID NO: 75277 - RNA, 1410 nt, Artificial Sequence
  derived and/or modified sequence opt1 from neuraminidase__InfluenzaA__AAY47016
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcgggaacgcccagcacguggaggagugcuccugcuacccccgguaccccggcgugcgcugcgucugccgggacaacuggaagggcagcaaccgcccgaucguggacaucaacgugaaggacuacuccaucgucagcuccuacgugugcagcgggcucgugggcgacacgccccggaagaacgacuccuucagcuccagccacugccuggaccccaacuccgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75278 - RNA, 1410 nt, Artificial Sequence
  derived and/or modified sequence opt1 from neuraminidase__InfluenzaA__AAY47055
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcaccagcgggaccuacggcacgggguccuggccggacggcgccgacaucaaccuguuccccaucuga

SEQ ID NO: 75279 - RNA, 1410 nt, Artificial Sequence
  derived and/or modified sequence opt1 from neuraminidase__InfluenzaA__AAY47078
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccacgacaagugcuaccaguucgcccugggccaggggaccacgcugaacaacggccacagcaacgacaccguccacgaccgcacccccuaccggacccuccugaugaacgagcugggcgugccguuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggcccaucguggacaucaacgugaaggacuacagcaucgucuccagcuacgugugcuccgggcucgugggcgacaccccgcgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagacggaggugugguggaccagcaacagcaucgucguguucugcggcaccuccgggaccuacggcacggggagcuggcccgacggcgccgacaucaaccugaugccgaucuga

SEQ ID NO: 75280 - RNA, 1410 nt, Artificial Sequence
  derived and/or modified sequence opt1 from neuraminidase__InfluenzaA__AAY47088
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggacguacggcaccgggagcuggccggacggcgccgacaucaaccugaugcccaucuga

SEQ ID NO: 75281 - RNA, 1410 nt, Artificial Sequence; identical to SEQ ID NO: 75145
  derived and/or modified sequence opt1 from neuraminidase__InfluenzaA__AAY58319

SEQ ID NO: 75282 - RNA, 1392 nt, Artificial Sequence
  derived and/or modified sequence opt1 from neuraminidase__InfluenzaA__AAY59038
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgaacgacaccguccacgaccgcaccccguaccggacccugcucaugaacgagcugggcgugcccuuccaccugggcacgaagcaggucugcaucgccuggagcuccagcuccugccacgacgggaaggcguggcuccacgugugcgugaccggcgacgacgagaacgccaccgccagcuucaucuacaacgggcgccugguggacuccaucggcagcugguccaagaagauccugcggacccaggagagcgagugcgucugcaucaacgggacgugcaccguggugaugaccgacggcuccgccagcggcaaggcggacaccaagauccucuucaucgaggaggggaagaucguccacacgagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccuggugggggacacgccccgcaagaacgacuccagcuccagcucccacugccucgaccccaacaacgaggagggcgggcacggcgucaaggggugggccuucgacgacggcaacgacguguggaugggccggaccaucagcgagaagcugcgcuccggguacgagaccuucaaggucaucgagggcuggagcaagccgaacuccaagcugcagaucaaccgccaggugaucguggaccgggggaaccggagcggcuacuccgggaucuucagcgucgagggcaaguccugcaucaaccgcugcuucuacguggagcucauccggggccgcaagcaggagaccgaggugcuguggaccagcaacagcaucgucguguucugcgggaccuccggcaccuacgggacgggcagcuggcccgacggggccgacaucaaccugaugcccaucuga

SEQ ID NO: 75283 - RNA, 1410 nt, Artificial Sequence
  derived and/or modified sequence opt1 from neuraminidase__InfluenzaA__AAY64195
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggccgggcggacaccaagauccuguucaucgaggaggggaagaucauccacaucagccagcucagcggcuccgcccagcacgucgaggagugcagcugcuacccccgcuaccccggggugcggugcgugugccgcgacaacuggaagggcuccaaccggcccaucgucgacaucaacgugaaggacuacagcaucguguccagcuacgucugcuccggccuggugggggacacgccgcgcaagaacgacagcuccagcuccagccacugccugaaccccaacaacgaggagggcgggcacggcgugaaggggugggccuucgacgacggcaacgacgucuggaugggccggaccaucuccgagaaguuccgcagcggguacgagaccuucaaggugaucgagggcugguccaagcccaacagcaagcuccagaucaaccggcaggucaucguggaccgcgacaaccgguccggguacagcggcaucuucuccguggagggcaagagcugcaucaaccgcugcuucuacgucgagcugauccgggggcgcaagcaggaggccgaggugugguggaccagcaacuccaucguggucuucugcggcacgagcgggaccuacggcaccggguccuggcccgacggcgccgacaucaaccugaugccgaucuga

SEQ ID NO: 75284 - RNA, 1410 nt, Artificial Sequence; identical to SEQ ID NO: 75143
  derived and/or modified sequence opt1 from neuraminidase__InfluenzaA__AAY64205

SEQ ID NO: 75285 - RNA, 1410 nt, Artificial Sequence; identical to SEQ ID NO: 75069
  derived and/or modified sequence opt1 from neuraminidase__InfluenzaA__AAY64215

SEQ ID NO: 75286 - RNA, 1410 nt, Artificial Sequence
  derived and/or modified sequence opt1 from neuraminidase__InfluenzaA__AAY64225
augaaccccaaccagaagaucaucaccaucggcagcgugucccugaccaucgccacgaucugcuuccucaugcagaucaccauccuggucaccaccgugacgcugcacuucaagcaguacgagugcaacccgccgcccaacaaccaggugaugcucugcgagcccaccaucaucgagcgcaacaucaccgagaucgucuaccugaccaacacgaccaucgagaaggagaucugccccaagcuggccgaguaccggaacuggagcaagccccagugcaacaucaccggguucgcgcccuucuccaaggacaacagcauccgccucuccgccggcggggacaucugggugacccgggagcccuacgugagcugcgacccggacaagugcuaccaguucgcccugggccaggggacgacccugaacaacggccacuccaacgacaccguccacgaccgcacccccuaccggacgcuccugaugaacgagcugggcgugcccuuccaccucgggacccgccaggugugcaucgccuggagcuccagcuccugccacgacggcaaggccuggcugcacgucugcgugaccggggacgacgagaacgcgaccgccagcuucaucuacaacggccggcugguggacuccaucgggagcugguccaagaagauccuccgcacgcaggagagcgagugcgucugcaucaacgggaccugcaccguggugaugaccgacggcuccgccagcgggaaggccgacacgaagauccuguucaucgaggagggcaagaucguccacaucuccacccugagcgggagcgcgcagcacguggaggagugcuccugcuacccccgguacccgggcgugcgcugcgucugccgggacaacuggaagggcagcaaccgccccaucguggacaucaacgugaaggacuacuccaucgucagcuccuacgugugcagcgggcucgugggcgacacgccccggaagaacgacuccuucagcuccagccacugccuggaccccaacaacgaggagggcggccacggggucaagggcugggccuucgacgacggcaacgacguguggauggggcgcaccaucuccgagaagcugcggagcggcuacgagaccuucaaggucaucgaggggugguccaagccgaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaacgaggugugguggaccuccaacagcaucgucguguucugcggcaccagcgggaccuacggcacgggguccuggcccgacggcgccgacaucaaccugaugcccaucuga

SEQ ID NO: 75287 - RNA, 1410 nt, Artificial Sequence
  derived and/or modified sequence opt1 from neuraminidase__InfluenzaA__AAY64245
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccucggccaggggaccacgcugaacaaccgccacagcaacgacaccguccacgaccggacccccuaccgcacccugcucaugaacgagcugggcgugccguuccaccugggcacgaagcaggucugcaucgccugguccagcuccagcugccacgacgggaaggcguggcuccacgugugcgugaccggccacgacgagaacgccaccgccuccuucaucuacgggggccggcugguggacagcaucggguccuggagcaagaagauccugcgcacccaggaguccgagugcgucugcaucaacggcacgugcaccguggugaugaccgacggcagcgccuccgggcgggcggacaccaagauccucuucaucgaggagggcaagaucauccacaucagccagcugagcggguccgcccagcacgucgaggagugcagcugcuacccccgcuaccccggcgugcggugcgugugccgcgacaacuggaagggcuccaaccggcccaucgucgacaucaacgugaaggacuacagcaucguguccagcuacgucugcuccgggcuggugggcgacacgccgcgcaagaacgacagcuccagcuccagccacugccucaaccccaacaacgaggagggcgggcacggggugaagggcugggccuucgacgacggcaacgacgucuggauggggcggaccaucuccgagaaguuccgcagcggcuacgagaccuucaaggugaucgaggggugguccaagcccaacagcaagcugcagaucaaccggcaggucaucguggaccgcgacaaccgguccggcuacagcgggaucuucuccguggagggcaagagcugcaucaaccgcugcuucuacgucgagcugauccggggccgcaagcaggagaccgaggugugguggacgagcaacuccaucguggucuucugcgggaccagcggcaccuacgggaccggcuccuggcccgacggggccgacaucaaccucaugccgaucuga

SEQ ID NO: 75288 - RNA, 1410 nt, Artificial Sequence; identical to SEQ ID NO: 75069
  derived and/or modified sequence opt1 from neuraminidase__InfluenzaA__AAY64255

SEQ ID NO: 75289 - RNA, 1410 nt, Artificial Sequence; identical to SEQ ID NO: 75287
  derived and/or modified sequence opt1 from neuraminidase__InfluenzaA__AAY64265

SEQ ID NO: 75290 - RNA, 1410 nt, Artificial Sequence; identical to SEQ ID NO: 75287
  derived and/or modified sequence opt1 from neuraminidase__InfluenzaA__AAY64285

SEQ ID NO: 75291 - RNA, 1410 nt, Artificial Sequence
  derived and/or modified sequence opt1 from neuraminidase__InfluenzaA__AAY64295
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuguccgaguaccggaacuggagcaagccgcagugcaacaucaccggguucgcgcccuucuccaaggacaacagcauccgccucuccgccggcggggacaucugggugacccgggagcccuacgugagcugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggagcuccagcuccugccacgacggcaaggccuggcugcacgugugcgugaccggggacgacgagaacgcgaccgccagcuucaucuacaacggccgccugguggacuccaucgggagcugguccaagaagauccuccggacccaggagagcgagugcgucugcaucaacggcacgugcaccguggugaugaccgacggcuccgccagcgggaaggccgacaccaagauccuguucaucgaggagggcaagaucguccacaucagcacgcuguccgggagcgcgcagcacguggaggagugcuccugcuacccccgcuaccccggcgugcggugcgucugccgcgacaacuggaagggcagcaaccggccgaucguggacaucaacgugaaggaccacuccaucgucagcuccuacgugugcagcgggcucgugggcgacacgccccgcaagaacgacuccuucagcuccagccacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagcccaacagcaagcuccagaucaaccgccaggugaucguggagcggggcaaccgguccggguacagcggcaucuucuccgucgagggcaagagcugcaucaaccgcugcuucuacguggagcugauccgggggcgcaaggaggagaccgaggugugguggaccagcaacuccaucgucguguucugcggcaccagcgggaccuacggcacgggguccuggccggacggcgccgacaucaaccugaugcccaucuga

SEQ ID NO: 75292 - RNA, 1410 nt, Artificial Sequence
  derived and/or modified sequence opt1 from neuraminidase__InfluenzaA__AAY64305
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacacgagcaagcugagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccucgugggggacacgccccgcaagaacgacagcuccagcuccagccacugccuggaccccaacaacgaggagggcgggcacggcgucaaggggugggccuucgacgacggcaacgacguguggaugggccggaccaucuccgagaagucccgcagcggguacgagaccuucaaggucaucgagggcuggagcaagcccaacuccaagcugcagaucaaccgccaggugaucguggagcgggggaacaugagcggcuacuccgggaucuucagcgucgagggcaagagcugcaucaaccggugcuucuacguggagcucauccgcggccggaagcaggagaccgaggugugguggaccuccaacagcaucgucguguucugcgggaccuccggcaccuacgggacgggcagcuggccggacggggccgacaucaaccugaugcccaucuga

SEQ ID NO: 75293 - RNA, 1410 nt, Artificial Sequence; identical to SEQ ID NO: 75143
  derived and/or modified sequence opt1 from neuraminidase__InfluenzaA__AAY64335

SEQ ID NO: 75294 - RNA, 1410 nt, Artificial Sequence; identical to SEQ ID NO: 75158
  derived and/or modified sequence opt1 from neuraminidase__InfluenzaA__AAY64365

SEQ ID NO: 75295 - RNA, 1410 nt, Artificial Sequence
  derived and/or modified sequence opt1 from neuraminidase__InfluenzaA__AAY64385
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccucggccaggggaccacgcugaacaaccgccacagcaacgacaccguccacgaccggacccccuaccgcacccugcucaugaacgagcugggcgugccguuccaccugggcacgaagcaggucugcaucgccugguccagcuccagcugccacgacgggaaggcguggcuccacgugugcgugaccggccacgacgagaacgccaccgccuccuucaucuacgggggccggcugguggacagcaucggguccuggagcaagaagauccugcgcacccaggaguccgagugcgucugcaucaacggcacgugcaccguggugaugaccgacggcagcgccuccgggcgggcggacaccaagauccucuucaucgaggagggcaagaucauccacaucagccagcugagcggguccgcccagcacgucgaggagugcagcugcuacccccgcuaccccggcgugcggugcgugugccgcgacaacuggaagggcuccaaccggcccaucgucgacaucaacgugaaggacuacagcaucguguccagcuacgucugcuccgggcuggugggcgacacgccgcgcaagaacgacagcuccagcuccagccacugccucaaccccaacaacgaggagggcgggcacggggugaagggcugggccuucgacgacggcaacgacgucuggauggggcggaccaucuccgagaagucccgcagcggcuacgagaccuucaaggugaucgagggguggagcaagcccaacuccaagcugcagaucaaccggcaggucaucguggaccgcgacaaccggagcggcuacuccgggaucuucagcguggagggcaagagcugcaucaaccgcugcuucuacgucgagcugauccggggccgcaagcaggagaccgaggugugguggacguccaacagcaucguggucuucugcgggaccuccggcaccuacgggaccggcagcuggcccgacggggccgacaucaaccucaugccgaucuga

SEQ ID NO: 75296 - RNA, 1410 nt, Artificial Sequence
  derived and/or modified sequence opt1 from neuraminidase__InfluenzaA__AAY64395
augaaccccaaccagaagaucaucaccaucggcagcgugucccugaucaucagcaccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggccgaguaccggaacuggagcaagccgcagugcgacaucacgggguucgcgcccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccagcuccugccacgacgggaaggccuggcuccacgugugcgugacgggcgacgacgagaacgcgaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggccgacaccaagauccucuucaucaaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaacuccaacagcaagcugcagaucaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcaccagcgggaccuacggcacgggguccuggcccgacggcgccgacaucaaccugaugccgaucuga

SEQ ID NO: 75297 - RNA, 1410 nt, Artificial Sequence; identical to SEQ ID NO: 75292
  derived and/or modified sequence opt1 from neuraminidase__InfluenzaA__AAY64405

SEQ ID NO: 75298 - RNA, 1410 nt, Artificial Sequence; identical to SEQ ID NO: 75287
  derived and/or modified sequence opt1 from neuraminidase__InfluenzaA__AAY98040

SEQ ID NO: 75299 - RNA, 1410 nt, Artificial Sequence; identical to SEQ ID NO: 75287
  derived and/or modified sequence opt1 from neuraminidase__InfluenzaA__AAY98050

SEQ ID NO: 75300 - RNA, 1410 nt, Artificial Sequence; identical to SEQ ID NO: 75179
  derived and/or modified sequence opt1 from neuraminidase__InfluenzaA__AAY98060

SEQ ID NO: 75301 - RNA, 1410 nt, Artificial Sequence
  derived and/or modified sequence opt1 from neuraminidase__InfluenzaA__AAY98070
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggaccacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaucuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcaccgggagcuggccggacggcgccgacaucaaccugaugcccaucuga

SEQ ID NO: 75302 - RNA, 1410 nt, Artificial Sequence; identical to SEQ ID NO: 75187
  derived and/or modified sequence opt1 from neuraminidase__InfluenzaA__AAY98080

SEQ ID NO: 75303 - RNA, 1410 nt, Artificial Sequence
  derived and/or modified sequence opt1 from neuraminidase__InfluenzaA__AAY98090
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggcaaggcggacaccaagauccuguucaucgaggaggggaagaucauccacaucagccagcucagcggcuccgcccagcacgucgaggagugcagcugcuacccccgguaccccggggugcgcugcgugugccgggacaacuggaagggcuccaaccgccccaucgucgacaucaacgugaaggacuacagcaucguguccagcuacgucugcuccggccuggugggggacacgccgcggaagaacgacagcuccagcuccagccacugccugaaccccaacaacgaggagggcgggcacggcgugaaggggugggccuucgacgacggcaacgacgucuggaugggccgcaccaucuccgagaaguuccggagcggguacgagaccuucaaggugaucgagggcugguccaagcccaacagcaagcuccagaucaaccgccaggucaucguggaccgggacaaccgcuccggguacagcggcaucuucuccguggagggcaagagcugcaucaaccggugcuucuacgucgagcugauccgcgggcggaagcaggagaccgaggugugguggacgagcaacuccaucguggucuucugcggcaccagcgggaccuacggcaccggguccuggcccgacggcgccgacaucaaccugaugccgaucuga

SEQ ID NO: 75304 - RNA, 1410 nt, Artificial Sequence; identical to SEQ ID NO: 75287
  derived and/or modified sequence opt1 from neuraminidase__InfluenzaA__AAY98100

SEQ ID NO: 75305 - RNA, 1410 nt, Artificial Sequence; identical to SEQ ID NO: 75287
  derived and/or modified sequence opt1 from neuraminidase__InfluenzaA__AAY98110

SEQ ID NO: 75306 - RNA, 1410 nt, Artificial Sequence; identical to SEQ ID NO: 75287
  derived and/or modified sequence opt1 from neuraminidase__InfluenzaA__AAY98120

SEQ ID NO: 75307 - RNA, 1410 nt, Artificial Sequence; identical to SEQ ID NO: 75287
  derived and/or modified sequence opt1 from neuraminidase__InfluenzaA__AAY98130

SEQ ID NO: 75308 - RNA, 1410 nt, Artificial Sequence; identical to SEQ ID NO: 75287
  derived and/or modified sequence opt1 from neuraminidase__InfluenzaA__AAY98150

SEQ ID NO: 75309 - RNA, 1410 nt, Artificial Sequence
  derived and/or modified sequence opt1 from neuraminidase__InfluenzaA__AAY98160
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccucggccaggggaccacgcugaacaaccgccacagcaacgacaccguccacgaccggacccccuaccgcacccugcucaugaacgagcugggcgugccguuccaccugggcacgaagcaggucugcaucgccugguccagcuccagcugccacgacgggaaggcguggcuccacgugugcgugaccggccacgacgagaacgccaccgccuccuucaucuacgggggccggcugguggacagcaucggguccuggagcaagaagauccugcgcacccaggaguccgagugcgucugcaucaacggcacgugcaccguggugaugaccgacggcagcgccuccgggcgggcggacaccaagauccucuucaucgaggagggcaagaucauccacaucagccagcugagcgggaacgcccagcacgucgaggagugcuccugcuacccccgcuaccccggcgugcggugcgugugccgcgacaacuggaagggcagcaaccggcccaucgucgacaucaacgugaaggacuacuccaucgugagcuccuacgucugcagcgggcuggugggcgacacgccgcgcaagaacgacuccagcuccagcuccaacugccucaaccccaacaacgaggagggcgggcacggggugaagggcugggccuucgacgacggcaacgacgucuggauggggcggaccaucagcgagaaguuccgcuccggcuacgagaccuucaaggugaucgagggguggagcaagcccaacuccaagcugcagaucaaccggcaggucaucguggaccgcgacaaccggagcggcuacuccgggaucuucagcguggagggcaaguccugcaucaaccgcugcuucuacgucgagcugauccggggccgcaagcaggagaccgaggugugguggacgagcaacagcaucguggucuucugcgggaccuccggcaccuacgggaccggcagcuggcccgacggggccgacaucaaccucaugccgaucuga

SEQ ID NO: 75310 - RNA, 1410 nt, Artificial Sequence; identical to SEQ ID NO: 75287
  derived and/or modified sequence opt1 from neuraminidase__InfluenzaA__AAY98170

SEQ ID NO: 75311 - RNA, 1410 nt, Artificial Sequence; identical to SEQ ID NO: 75287
  derived and/or modified sequence opt1 from neuraminidase__InfluenzaA__AAY98180

SEQ ID NO: 75312 - RNA, 1410 nt, Artificial Sequence; identical to SEQ ID NO: 75287
  derived and/or modified sequence opt1 from neuraminidase__InfluenzaA__AAY98200

SEQ ID NO: 75313 - RNA, 1410 nt, Artificial Sequence; identical to SEQ ID NO: 75287
  derived and/or modified sequence opt1 from neuraminidase__InfluenzaA__AAY98210

SEQ ID NO: 75314 - RNA, 1410 nt, Artificial Sequence; identical to SEQ ID NO: 75292
  derived and/or modified sequence opt1 from neuraminidase__InfluenzaA__AAY98220

SEQ ID NO: 75315 - RNA, 1410 nt, Artificial Sequence; identical to SEQ ID NO: 75287
  derived and/or modified sequence opt1 from neuraminidase__InfluenzaA__AAY98230

SEQ ID NO: 75316 - RNA, 1410 nt, Artificial Sequence
  derived and/or modified sequence opt1 from neuraminidase__InfluenzaA__AAY98250
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccucggccaggggaccacgcugaacaaccgccacagcaacgacaccguccacgaccggacccccuaccgcacccugcucaugaacgagcugggcgugccguuccaccugggcacgaagcaggucugcaucgccugguccagcuccagcugccacgacgggaaggcguggcuccacgugugcgugaccggccacgacgagaacgccaccgccuccuucaucuacgggggccggcugguggacagcaucggguccuggagcaagaagauccugcgcacccaggaguccgagugcgucugcaucaacggcacgugcaccguggugaugaccgacggcagcgccuccgggcgggcggacaccaagauccucuucaucgaggagggcaagaucauccacaucagccagcugagcggguccgcccagcacgucgaggagugcagcugcuacccccgcuaccccggcgugcggugcgugugccgcgacaacuggaagggcuccaaccggcccaucgucgacaucaacgugaaggacuacagcaucguguccagcuacgucugcuccgggcuggugggcgacacgccgcgcaagaacgacagcuccagcuccagccacugccucaaccccaacaacgaggagggcgggcacggggugaagggcugggccuucgacgacggcaacgacgucuggauggggcggaccaucuccgagaaguuccgcagcggcuacgagaccuucaaggugaucgaggggugguccaagcccaacagcaagcugcagaucaaccggcaggucaucguggaccgcgacaaccgguccggcuacagcgggaucuucuccguggaggacaagagcugcaucaaccgcugcuucuacgucgagcugauccggggccgcaagcaggagaccgaggugugguggacgagcaacuccaucguggucuucugcggcaccagcgggaccuacggcaccggguccuggcccgacggcgccgacaucaaccucaugccgaucuga

SEQ ID NO: 75317 - RNA, 1410 nt, Artificial Sequence; identical to SEQ ID NO: 75287
  derived and/or modified sequence opt1 from neuraminidase__InfluenzaA__AAY98322

SEQ ID NO: 75318 - RNA, 1410 nt, Artificial Sequence; identical to SEQ ID NO: 75292
  derived and/or modified sequence opt1 from neuraminidase__InfluenzaA__AAY98332

SEQ ID NO: 75319 - RNA, 1410 nt, Artificial Sequence; identical to SEQ ID NO: 75287
  derived and/or modified sequence opt1 from neuraminidase__InfluenzaA__AAY98342

SEQ ID NO: 75320 - RNA, 1410 nt, Artificial Sequence; identical to SEQ ID NO: 75287
  derived and/or modified sequence opt1 from neuraminidase__InfluenzaA__AAY98359

SEQ ID NO: 75321 - RNA, 1410 nt, Artificial Sequence; identical to SEQ ID NO: 75292
  derived and/or modified sequence opt1 from neuraminidase__InfluenzaA__AAY98369

SEQ ID NO: 75322 - RNA, 1410 nt, Artificial Sequence
  derived and/or modified sequence opt1 from neuraminidase__InfluenzaA__AAY98379
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgggggccggcucguggacagcaucggguccuggagcaagaagauccugcgcacccaggaguccgagugcgucugcaucaacggcacgugcaccguggugaugaccgacggcagcgccuccgggcgggcggacaccaagauccuguucaucgaggagggcaagaucauccacaucagccagcucagcggguccgcccagcacgucgaggagugcagcugcuacccccgcuaccccggcgugcggugcgugugccgcgacaacuggaagggcuccaaccggcccaucgucgacaucaacgugaaggacuacagcaucguguccagcuacgucugcuccgggcuggugggcgacacgccgcgcaagaacgacagcuccagcuccagccacugccugaaccccaacaacgaggagggcgggcacggggugaagggcugggccuucgacgacggcaacgacgucuggauggggcggaccaucuccgagaaguuccgcagcggcuacgagaccuucaaggugaucgaggggugguccaagcccaacagcaagcuccagaucaaccggcaggucaucguggaccgcaacaaccgguccggcuacagcgggaucuucuccguggagggcaagagcugcaucaaccgcugcuucuacgucgagcugauccggggccgcaagcaggagaccgaggugugguggacgagcaacuccaucguggucuucugcgggaccagcggcaccuacgggaccggcuccuggcccgacggggccgacaucaaccugaugccgaucuga

SEQ ID NO: 75323 - RNA, 1410 nt, Artificial Sequence
  derived and/or modified sequence opt1 from neuraminidase__InfluenzaA__AAY98389
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgggggccggcucguggacagcaucggguccuggagcaagaagauccugcgcacccaggaguccgagugcgucugcaucaacggcacgugcaccguggugaugaccgacggcagcgccuccgggcgggcggacaccaagauccuguucaucgaggagggcaagaucauccacaucagccagcucagcggguccgcccagcacgucgaggagugcagcugcuacccccgcuaccccggcgugcggugcgugugccgcgacaacuggaagggcuccaaccggcccaucgucgacaucaacgugaaggacuacagcaucguguccagcuacgucugcuccgggcuggugggcgacacgccgcgcaagaacgacagcuccagcuccagccacugccugaaccccaacaacgaggagggcgggcacggggugaagggcugggccuucgacgacggcaacgacgucuggauggggcggaccaucuccgagaaguuccgcagcggcuacgagaccuucaaggugaucgaggggugguccaagcccaacagcaagcuccagaucaaccggcaggucaucguggaccgcgacaaccgguccggcuacagcgggaucuucuccguggagggcaagagcugcaucaaccgcugcuucuacgucgagcugauccggggccgcaagcaggagaccgaggugugguggacgagcaacuccaucguggucuucugcgggaccagcggcaccuacgggaccggcuccuggcccgacggggccgacaucaaccugaugccgaucuga

SEQ ID NO: 75324 - RNA, 1410 nt, Artificial Sequence; identical to SEQ ID NO: 75287
  derived and/or modified sequence opt1 from neuraminidase__InfluenzaA__AAY98399

SEQ ID NO: 75325 - RNA, 1410 nt, Artificial Sequence; identical to SEQ ID NO: 75287
  derived and/or modified sequence opt1 from neuraminidase__InfluenzaA__AAY98409

SEQ ID NO: 75326 - RNA, 1410 nt, Artificial Sequence; identical to SEQ ID NO: 75287
  derived and/or modified sequence opt1 from neuraminidase__InfluenzaA__AAY98773

SEQ ID NO: 75327 - RNA, 1410 nt, Artificial Sequence
  derived and/or modified sequence opt1 from neuraminidase__InfluenzaA__AAZ32955
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaucguccacgagcgcaccccguaccggacccugcucaugaacgagcugggcgugcccuuccaccugggcaccaagcaggucugcaucgccuggagcuccagcuccugccacgacgggaaggccuggcuccacgugugcgugacgggcgacgacgagaacgcgaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggaccuacggcacggggagcuggccggacggcgccgacaucaaccugaugcccaucuga

SEQ ID NO: 75328 - RNA, 1344 nt, Artificial Sequence
  derived and/or modified sequence opt1 from neuraminidase__InfluenzaA__AAZ32957
augaaccccaaccagaagaucaucaccaucggcagcgugucccugaccaucagcacgaucugcuucuucaugcagaucgccauccucaucaccaccgucacccugaucgagcgcaacaucacggagaucguguaccugaccaacaccaccaucgagaaggagaucugcccgaagcucgccgaguaccggaacugguccaagccccagugcaacaucacgggguucgcgcccuucagcaaggacaacuccauccgccugagcgccggcggggacaucugggugacccgggagcccuacgucuccugcgacccggacaagugcuaccaguucgcccugggccaggggaccacccucaacaacgugcacagcaacgacacggugcacgaccgcacccccuaccggacccugcugaugaacgagcucggcguccccuuccaccugggcaccaagcaggucugcaucgccugguccagcuccagcugccacgacgggaaggccuggcugcacgugugcgugacgggcgacgacgagaacgcgaccgccuccuucaucuacaacgggcgccucguggacagcaucguguccuggagcaagaagauccugcggacccaggaguccgagugcgucugcaucaacgggaccugcacgguggugaugaccgacgggaacgccagcggcaaggccgacaccaagauccuguucaucgaggagggcaagaucguccacaccuccacgcucagcgggagcgcgcagcacguggaggagugcuccugcuacccccgcuacccgggcgugcggugcgucugccgcgacaacuggaaggggagcaaccggcccaucguggacaucaacaucaaggacuacuccaucgugagcuccuacgucugcagcggccuggugggcgacacgccccgcaagaacgacuccagcuccagcucccacugccuggaccccaacaacgaggagggcggccacggggugaagggcugggccuucgacgacgggaacgacgucuggaugggccggaccaucagcgagaagcuccgcuccggcuacgagaccuucaaggugaucgagggguggagcaacccgaacuccaagcugcagaucaaccggcaggucaucguggaccgcggcaaccggagcggguacuccggcaucuucagcguggaggggaaguccugcaucaaccgcugcuucuacgucgagcugauccggggccgcaagcaggagaccgaggugcucuggaccagcaacagcaucguggucuucugcggcaccuccgggaccuacggcacggggagcuggcccgacggcgccgacaucaaccugaugcccaucuga

SEQ ID NO: 75329 - RNA, 1344 nt, Artificial Sequence; identical to SEQ ID NO: 75328
  derived and/or modified sequence opt1 from neuraminidase__InfluenzaA__AAZ32958

SEQ ID NO: 75330 - RNA, 1344 nt, Artificial Sequence; identical to SEQ ID NO: 75328
  derived and/or modified sequence opt1 from neuraminidase__InfluenzaA__AAZ32959

SEQ ID NO: 75331 - RNA, 1410 nt, Artificial Sequence; identical to SEQ ID NO: 75292
  derived and/or modified sequence opt1 from neuraminidase__InfluenzaA__AAZ38465

SEQ ID NO: 75332 - RNA, 1410 nt, Artificial Sequence; identical to SEQ ID NO: 75292
  derived and/or modified sequence opt1 from neuraminidase__InfluenzaA__AAZ38476

SEQ ID NO: 75333 - RNA, 1410 nt, Artificial Sequence
  derived and/or modified sequence opt1 from neuraminidase__InfluenzaA__AAZ38487
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccucggccaggggaccacgcugaacaaccgccacagcaacgacaccguccacgaccggacccccuaccgcacccugcucaugaacgagcugggcgugccguuccaccugggcacgaagcaggucugcaucgccugguccagcuccagcugccacgacgggaaggcguggcuccacgugugcgugaccggccacgacgagaacgccaccgccuccuucaucuacgggggccggcugguggacagcaucggguccuggagcaagaagauccugcgcacccaggaguccgagugcgucugcaucaacggcacgugcaccguggugaugaccgacggcagcgccuccgggcgggcggacaccaagauccucuucaucgaggagggcaagaucauccacaucagccagcugagcggguccgcccagcacgucgaggagugcagcugcuacccccgcuaccccggcgugcggugcgugugccgcgacaacuggaagggcuccaaccggcccaucgucgacaucaacgugaaggacuacagcaucguguccagcuacgucugcuccgggcuggugggcgacacgccgcgcaagaacgacagcuccagcuccagcaacugccucaaccccaacaacgaggagggcgggcacggggugaagggcugggccuucgacgacggcaacgacgucuggauggggcggaccaucuccgagaaguuccgcagcggcuacgagaccuucaaggugaucgaggggugguccaagcccaacagcaagcugcagaucaaccggcaggucaucguggaccgcgacaaccgguccggcuacagcgggaucuucuccguggagggcaagagcugcaucaaccgcugcuucuacgucgagcugauccggggccgcaagcaggagaccgaggugugguggacgagcaacuccaucguggucuucugcgggaccagcggcaccuacgggaccggcuccuggcccgacggggccgacaucaaccucaugccgaucuga

SEQ ID NO: 75334 - RNA, 1410 nt, Artificial Sequence
  derived and/or modified sequence opt1 from neuraminidase__InfluenzaA__AAZ38509
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaacuccaacagcaagcugcagaucaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcaccagcgggacguacggcaccggguccuggcccgacggcgccgacaucaaccugaugccgaucuga

SEQ ID NO: 75335 - RNA, 1410 nt, Artificial Sequence
  derived and/or modified sequence opt1 from neuraminidase__InfluenzaA__AAZ38586
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 75336 - RNA, 1410 nt, Artificial Sequence; identical to SEQ ID NO: 75335
  derived and/or modified sequence opt1 from neuraminidase__InfluenzaA__AAZ38597

SEQ ID NO: 75337 - RNA, 1410 nt, Artificial Sequence
  derived and/or modified sequence opt1 from neuraminidase__InfluenzaA__AAZ38608
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaugugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucauccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaagcccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaccaaccugaugcccaucuga

SEQ ID NO: 75338 - RNA, 1410 nt, Artificial Sequence
  derived and/or modified sequence opt1 from neuraminidase__InfluenzaA__AAZ38619
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaugugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucauccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaagcccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 75339 - RNA, 1410 nt, Artificial Sequence; identical to SEQ ID NO: 75335
  derived and/or modified sequence opt1 from neuraminidase__InfluenzaA__AAZ38641

SEQ ID NO: 75340 - RNA, 1410 nt, Artificial Sequence; identical to SEQ ID NO: 75335
  derived and/or modified sequence opt1 from neuraminidase__InfluenzaA__AAZ38653

SEQ ID NO: 75341 - RNA, 1410 nt, Artificial Sequence; identical to SEQ ID NO: 75126
  derived and/or modified sequence opt1 from neuraminidase__InfluenzaA__AAZ43386

SEQ ID NO: 75342 - RNA, 1410 nt, Artificial Sequence
  derived and/or modified sequence opt1 from neuraminidase__InfluenzaA__AAZ43397
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagcgggagaucugccccaagcuggcggaguaccgcaacugguccaagccgcagugcaacaucaccggguucgcccccuucagcaaggacaacuccauccggcucagcgccggcggggacaucugggugacccgcgagcccuacguguccugcgaccccgacaagugcuaccaguucgcccugggccaggggaccacgcugaacaacggccacagcaacgacaccguccacgaccggaccccguaccgcacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagcccaacagcaagcuccagaccaaccgccaggugaucguggagcggggcaaccgguccggguacagcggcaucuucuccgucgagggcaagagcugcaucaaccgcugcuucuacguggagcugauccgggggcgcaaggaggagaccgaggugugguggaccagcaacuccaucgucguguucugcggcaccagcgggacguacggcaccggguccuggccggacggcgccgacaucaaccugaugcccaucuga

SEQ ID NO: 75343 - RNA, 1410 nt, Artificial Sequence
  derived and/or modified sequence opt1 from neuraminidase__InfluenzaA__AAZ43408
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaugaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagagcaaguccugcaucaaccgcugcuucuacguggagcugauccggggccgcaagcaggagaccgaggugcuguggaccagcaacuccaucgucguguucugcgggaccagcggcaccuacgggacgggcuccuggccggacggggccgacaucaaccucaugcccaucuga

SEQ ID NO: 75344 - RNA, 1410 nt, Artificial Sequence
  derived and/or modified sequence opt1 from neuraminidase__InfluenzaA__AAZ74355
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggcgaugcccugcgagcccgccaucaucgagcgcaacacgaccgagaccguguaccucaccaacacgaccaucgagaaggagaucugcccgaagcuggccgaguaccggaacugguccaagccccagugcaacaucaccggguucgcccccuucagcaaggacaacuccauccgccugagcgccggcggggacaucugggucacccgggagcccuacguguccugcgacccggacaagugcuaccaguucgcgcucggccaggggacgacccugaacaacggccacagcaacgacaccgugcacgaccgcacccccuaccggacgcugcucaugaacgagcugggcguccccuuccaccuggggacccgccaggugugcaucgccugguccagcuccagcugccacgacggcaaggccuggcuccacgugugcgucaccggggacgacgagaacgccaccgcguccuucaucuacaacggccggcugguggacagcaucggguccuggagcaagaagauccugcgcacgcaggaguccgagugcgugugcaucaacgggaccugcaccgucgugaugaccgacggcagcgccuccgggaaggccgacacgaagauccucuucaucgaggagggcaagaucgugcacaucagcacccugagcggguccgcccagcacgucgaggagugcagcugcuacccccgguacccgggcgugcgcugcgugugccgggacaacuggaagggcuccaaccgccccaucgucgacaucaacgugaaggacuacagcaucguguccagcuacgucugcuccgggcuggugggcgacacgccccggaagaacgacagcuucuccagcucccacugccucgaccccaacaacgaggagggcggccacggggugaagggcugggccuucgacgacggcaacgacgucuggauggggcgcaccaucagcgagaagcugcgguccggcuacgagaccuucaaggugaucgagggguggagcaagccgaacuccaagcugcagaucaaccgccaggucaucguggagcggggcaaccgcagcggguacuccggcaucuucagcguggagggcaaguccugcaucaaccggugcuucuacgucgagcucauccgcgggcggaaggaggagaccgaggugugguggaccagcaacagcaucguggucuucugcggcaccuccgggacguacggcaccgggagcuggcccgacggcgcggacaucaaccugaugcccaucuga

SEQ ID NO: 75345 - RNA, 1410 nt, Artificial Sequence
  derived and/or modified sequence opt1 from neuraminidase__InfluenzaA__AAZ74366
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggcaaggcggacaccaagauccuguucaucgaggaggggaagaucauccacaucagccagcucagcggcuccgcccagcacgucgaggagugcagcugcuacccccgguaccccggggugcgcugcgugugccgggacaacuggaagggcuccaaccgccccaucgucgacaucaacgugaaggacuacagcaucguguccagcuacgucugcuccggccuggugggggacacgccgcggaagaacgacagcuccagcuccagccacugccugaaccccaacaacgaggagggcgggcacggcgugaaggggugggccuucgacgacggcaacgacgucuggaugggccgcaccaucuccgagaaguuccggagcggguacgagaccuucaaggugaucgagggcugguccaagcccaacagcaagcuccagaucaaccgccaggucaucguggacaaggacaaccgguccggguacagcggcaucuucuccguggagggcaagagcugcaucaaccgcugcuucuacgucgagcugauccgggggcgcaagcaggagaccgaggugugguggacgagcaacuccaucguggucuucugcggcaccagcgggaccuacggcaccggguccuggcccgacggcgccgacaucaaccugaugccgaucuga

SEQ ID NO: 75346 - RNA, 1410 nt, Artificial Sequence
  derived and/or modified sequence opt1 from neuraminidase__InfluenzaA__AAZ74377
augaaccccaaccagaagaucaucaccaucggcagcgugucccugaccaucgccacgaucugcuuccucacccagaucgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggaccaagcaggucugcaucgccugguccagcuccagcugccacgacggcaaggcguggcugcacgugugcgugaccggggacgacaagaacgccaccgccuccuucaucuacaacggccgccugguggacagcaucggguccuggagcaagaagauccuccggacgcaggaguccgagugcgucugcaucaacgggaccugcaccguggugaugaccgacggcagcgccuccgggaaggcggacacgaagauccuguucaucgaggagggcaagaucguccacaccagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcggccacggggucaagggcugggccuucgacgacggcaacgacguguggauggggcggaccauccgcgagaagcuccgguccggcuacgagaccuucaaggucaucgagggguggagcaagcccaacuccaagcugcagaucaaccgccaggugaucguggaccgggacaaccgcagcggcuacuccgggaucuucagcgucgagggcaaguccugcaucaaccggugcuucuacguggagcugauccgcggccggaaccaggagaccgaggugcucuggaccagcaacagcaucgucguguucugcgggaccuccggcacguacgggaccggcagcuggccggacggggccgacaucaaccugaugcccaucuga

SEQ ID NO: 75347 - RNA, 1410 nt, Artificial Sequence
  derived and/or modified sequence opt1 from neuraminidase__InfluenzaA__AAZ74400
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccucccugaucuacgacgggcggcucguggacagcaucggcuccuggagcaagaagauccugcgcacccaggaguccgagugcgucugcaucaacgggacgugcaccguggugaugaccgacggcagcgccuccggccgggcggacaccaagauccuguucaucgaggaggggaagaucguccacacgagcaagcucagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccuggugggggacacgccccgcaagaacgacagcuccagcuccagccacugccuggaccccaacaacgaggagggcgggcacggcgucaaggggugggccuucgacgacggcaacgacguguggaugggccggaccaucuccgagaagucccgcagcggguacgagaccuucaaggucaucgagggcuggagcaagcccaacuccaagcuccagaucaaccgccaggugaucguggagcgggggaacaugagcggcuacuccgggaucuucagcgucgagggcaagagcugcaucaaccggugcuucuacguggagcugauccgcggccggaagcaggagaccgaggugugguggaccuccaacagcaucgucguguucugcgggaccuccggcaccuacgggacgggcagcuggccggacggggccgacaucaaccugaugcccaucuga

SEQ ID NO: 75348 - RNA, 1410 nt, Artificial Sequence; identical to SEQ ID NO: 75287
  derived and/or modified sequence opt1 from neuraminidase__InfluenzaA__AAZ74411

SEQ ID NO: 75349 - RNA, 1410 nt, Artificial Sequence
  derived and/or modified sequence opt1 from neuraminidase__InfluenzaA__AAZ74422
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacgacaccguccacgaccgcacccccuaccggacccugcugaugaacgagcucggcgugcccuuccaccugggcacgaagcaggucugcaucgccuggagcuccagcuccugccacgacgggaaggccuggcugcacgugugcgugaccggcgacgacaagaacgcgaccgccagcuucaucuacaacgggcgccucguggacuccaucgucagcugguccaaggagauccugcggacccaggagagcgagugcgugugcaucaacggcacgugcgccguggucaugaccgacggguccgccagcggcaaggcggacaccaagauccuguucaucgaggagggcaagaucgugcacaccagcaagcucuccgggagcgcccagcacguggaggagugcuccugcuacccccgcuacccgggcauccggugcgucugccgcgacaacuggaaggggagcaaccggcccaucguggacaucaacaucaaggacuacuccaucgugagcuccuacgucugcagcggccuggugggcgacacgccccgcaagaacgacuccagcuccagcucccacugccuggaccccaacaacgaggagggcgggcacggggugaagggcugggccuucgacgacgggaacgacgucuggaugggccggaccaucagcgagaagcuccgcuccggcuacgagaccuucaaggugaucgagggguggagcaacccgaacuccaagcugcagaucaaccggcaggucaucguggaccgcggcaaccggagcggguacuccggcaucuucagcguggagggcaagagcugcaucaaccgcugcuucuacgucgagcugauccgggggcgcaaggaggagaccgaggugcucuggacguccaacagcaucguggucuucugcggcaccuccgggaccuacggcaccgggagcuggcccgacggcgccgacaucaaccugaugcccaucuga

SEQ ID NO: 75350 - RNA, 1410 nt, Artificial Sequence; identical to SEQ ID NO: 75335
  derived and/or modified sequence opt1 from neuraminidase__InfluenzaA__AAZ74444

SEQ ID NO: 75351 - RNA, 1410 nt, Artificial Sequence
  derived and/or modified sequence opt1 from neuraminidase__InfluenzaA__AAZ74455
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggacauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaucaaccgccaggugaucguggagcggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 75352 - RNA, 1410 nt, Artificial Sequence; identical to SEQ ID NO: 75335
  derived and/or modified sequence opt1 from neuraminidase__InfluenzaA__AAZ74477

SEQ ID NO: 75353 - RNA, 1410 nt, Artificial Sequence; identical to SEQ ID NO: 75351
  derived and/or modified sequence opt1 from neuraminidase__InfluenzaA__AAZ74488

SEQ ID NO: 75354 - RNA, 1410 nt, Artificial Sequence
  derived and/or modified sequence opt1 from neuraminidase__InfluenzaA__AAZ74499
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcgccguggucaugaccgacggguccgccagcggcaaggcggacaccaagauccucuucaucgaggagggcaagaucgugcacaccagcaagcuguccgggagcgcccagcacguggaggagugcuccugcuacccccgcuaccccggcauccggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggacguccaacagcaucguggucuucugcggcaccuccgggaccuacggcaccgggagcuggccggacggcgccgacaucaaccugaugcccaucuga

SEQ ID NO: 75355 - RNA, 1410 nt, Artificial Sequence; identical to SEQ ID NO: 75351
  derived and/or modified sequence opt1 from neuraminidase__InfluenzaA__AAZ74510

SEQ ID NO: 75356 - RNA, 1410 nt, Artificial Sequence; identical to SEQ ID NO: 75354
  derived and/or modified sequence opt1 from neuraminidase__InfluenzaA__AAZ74521

SEQ ID NO: 75357 - RNA, 1410 nt, Artificial Sequence
  derived and/or modified sequence opt1 from neuraminidase__InfluenzaA__AAZ74532
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggacauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggaacgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgccugggcuacgagaccuucaaggucaucgagggguggagcaaccccaacuccaagcuccagaucaaccgccaggugaucguggagcggggcaaccggagcggguacuccggcaucuucagcgucgaggggaaguccugcaucaaccgcugcuucuacguggagcugauccggggccgcaaggaggagaccgaggugcuguggaccagcaacagcaucgucguguucugcggcaccuccgggacguacggcaccgggagcuggccggacggcgccaacaucaaccucaugcccaucuga

SEQ ID NO: 75358 - RNA, 1410 nt, Artificial Sequence; identical to SEQ ID NO: 75335
  derived and/or modified sequence opt1 from neuraminidase__InfluenzaA__AAZ74543

SEQ ID NO: 75359 - RNA, 1410 nt, Artificial Sequence; identical to SEQ ID NO: 75287
  derived and/or modified sequence opt1 from neuraminidase__InfluenzaA__AAZ74565

SEQ ID NO: 75360 - RNA, 1410 nt, Artificial Sequence; identical to SEQ ID NO: 75335
  derived and/or modified sequence opt1 from neuraminidase__InfluenzaA__AAZ74598

SEQ ID NO: 75361 - RNA, 1410 nt, Artificial Sequence
  derived and/or modified sequence opt1 from neuraminidase__InfluenzaA__AAZ74609
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccaucaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucagcgccggcggggacaucugggugacccgggagcccuacguguccugcgaccccgacaagugcuaccaguucgcccugggccaggggaccacccugaacaaccgccacagcaacgacacgguccacgaccggaccccguaccgcacccuccugaugaacgagcugggcgugcccuuccaccucggcaccaagcaggucugcaucgccugguccagcuccagcugccacgacgggaaggcguggcugcacgugugcgugacgggccacgacgagaacgccaccgccuccuucaucuacgacgggcggcugguggacagcaucuccagcugguccaagaacauccuccgcacccaggagagcgagugcgucugcaucaacgggaccugcacgguggugaugaccgacggguccgccagcgagcgggcggacaccaagauccuguucaucgaggagggcaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcgggcucgugggcgacacgccccgcaagaacgacuccagcuccagcuccuacugccugaaccccaacaacgaggagggcgggcacggcgucaaggggugggccuucgacgacggcaacgacguguggauggggcggaccaucagcgagaagcugcgcuccggcuacgagaccuucaaggucaucggcggguggagcaagccgaacuccaagcuccagaucaaccgccaggugaucguggaccggggcaaccggagcggguacuccggcaucuucagcgucgagggcaagagcugcgugaaccgcugcuucuacguggagcugauccggggccgcaagcaggagaccgaggucugguggaccuccaacagcaucgugguguucugcggcacguccgggaccuacggcaccgggagcuggcccgacggcgccgacaucaaccugaugcccaucuga

SEQ ID NO: 75362 - RNA, 1410 nt, Artificial Sequence; identical to SEQ ID NO: 75069
  derived and/or modified sequence opt1 from neuraminidase__InfluenzaA__AAZ74620

SEQ ID NO: 75363 - RNA, 1410 nt, Artificial Sequence; identical to SEQ ID NO: 75181
  derived and/or modified sequence opt1 from neuraminidase__InfluenzaA__AAZ79508

SEQ ID NO: 75364 - RNA, 1410 nt, Artificial Sequence
  derived and/or modified sequence opt1 from neuraminidase__InfluenzaA__AAZ79519
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgauccuggagcgcaacaucaccgagaucgucuaccugaccaacaccacgaucgagaaggagaucugccccaagcucgcggaguaccggaacugguccaagccgcagugcaagaucaccggguucgcccccuucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggaccccguaccgcacccugcugaugaacgagcucggcgugcccuuccaccugggcacgaagcaggucugcaucgccugguccagcuccagcugccacgacgggaaggcguggcugcacgugugcgugaccggccacgacaagaacgccaccgccuccuucaucuacgggggccggcucguggacagcaucggguccuggagcaagaagauccugcgcacccaggaguccgagugcgucugcaucaacggcacgugcaccguggugaugaccgacggcagcgccuccgggcgggcggacaccaagauccuguucaucgaggagggcaagaucauccacaucagccagcucagcggguccgcccagcacgucgaggagugcagcugcuacccccgcuaccccggcgugcggugcgugugccgcgacaacuggaagggcuccaaccggccgaucgucgacaucaacgugaaggacuacagcaucguguccagcuacgucugcuccgggcuggugggcgacacgccccgcaagaacgacagcuccagcuccagccacugccugaaccccaacaacgaggagggcgggcacggggugaagggcugggccuucgacgacggcaacgacgucuggauggggcggaccaucuccgagaaguuccgcagcggcuacgagaccuucaaggugaucgagggguggucccggcccaacagcaagcuccagaucaaccgccaggucaucguggaccgggacaaccgcuccggcuacagcgggaucuucuccguggagggcaagagcugcaucaaccggugcuucuacgucgagcugauccgcggccgcaagcaggagaccgaggugugguggacgagcaacuccaucguggucuucugcgggaccagcggcaccuacgggaccggcuccuggccggacggggccgacaucaaccugaugcccaucuga

SEQ ID NO: 75365 - RNA, 1410 nt, Artificial Sequence; identical to SEQ ID NO: 75145
  derived and/or modified sequence opt1 from neuraminidase__InfluenzaA__AAZ79530

SEQ ID NO: 75366 - RNA, 1410 nt, Artificial Sequence
  derived and/or modified sequence opt1 from neuraminidase__InfluenzaA__AAZ79552
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccgcaccggacccuccugaugaacgagcugggcgugcccuuccaccucgggacgaagcaggucugcaucgccugguccagcuccagcugccacgacggcaaggcguggcugcacgugugcgugaccggggacgacaagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccgggacaaccgguccggcuacagcgggaucuucuccgucgagggcaagagcugcaucaaccgcugcuucuacguggagcugauccggggccgcaaccaggagaccgaggugcucuggaccagcaacuccaucgucguguucugcgggaccagcggcaccuacgggacgggcuccuggccggacggggccgacaucaaccugaugcccaucuga

SEQ ID NO: 75367 - RNA, 1410 nt, Artificial Sequence; identical to SEQ ID NO: 75287
  derived and/or modified sequence opt1 from neuraminidase__InfluenzaA__AAZ79563

SEQ ID NO: 75368 - RNA, 1410 nt, Artificial Sequence; identical to SEQ ID NO: 75287
  derived and/or modified sequence opt1 from neuraminidase__InfluenzaA__AAZ79574

SEQ ID NO: 75369 - RNA, 1410 nt, Artificial Sequence; identical to SEQ ID NO: 75287
  derived and/or modified sequence opt1 from neuraminidase__InfluenzaA__AAZ79585

SEQ ID NO: 75370 - RNA, 1410 nt, Artificial Sequence; identical to SEQ ID NO: 75354
  derived and/or modified sequence opt1 from neuraminidase__InfluenzaA__AAZ79618

SEQ ID NO: 75371 - RNA, 1410 nt, Artificial Sequence; identical to SEQ ID NO: 75335
  derived and/or modified sequence opt1 from neuraminidase__InfluenzaA__AAZ79633

SEQ ID NO: 75372 - RNA, 1410 nt, Artificial Sequence; identical to SEQ ID NO: 75354
  derived and/or modified sequence opt1 from neuraminidase__InfluenzaA__AAZ79945

SEQ ID NO: 75373 - RNA, 1410 nt, Artificial Sequence; identical to SEQ ID NO: 75351
  derived and/or modified sequence opt1 from neuraminidase__InfluenzaA__AAZ79966

SEQ ID NO: 75374 - RNA, 1410 nt, Artificial Sequence; identical to SEQ ID NO: 75335
  derived and/or modified sequence opt1 from neuraminidase__InfluenzaA__AAZ79977

SEQ ID NO: 75375 - RNA, 1410 nt, Artificial Sequence; identical to SEQ ID NO: 75335
  derived and/or modified sequence opt1 from neuraminidase__InfluenzaA__AAZ79988

SEQ ID NO: 75376 - RNA, 1410 nt, Artificial Sequence
  derived and/or modified sequence opt1 from neuraminidase__InfluenzaA__AAZ79999
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgucagcugcgaccccgacaagugcuaccaguucgcccucggccaggggaccacgcugaacaacgugcacuccaacgacaccgugcacgaccgcaccccguaccggacccugcucaugaacgagcugggcguccccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgugagcugguccaaggacauccugcggacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccggcaggucaucguggagcgcggcaaccgguccggguacagcggcaucuucuccguggagggcaagagcugcaucaaccgcugcuucuacgucgagcugauccgggggcgcaaggaggagaccgaggugcuguggaccagcaacuccaucguggucuucugcggcaccagcgggacguacggcaccggguccuggccggacggcgccgacaucaaccucaugcccaucuga

SEQ ID NO: 75377 - RNA, 1410 nt, Artificial Sequence; identical to SEQ ID NO: 75123
  derived and/or modified sequence opt1 from neuraminidase__InfluenzaA__AAZ80010

SEQ ID NO: 75378 - RNA, 1410 nt, Artificial Sequence
  derived and/or modified sequence opt1 from neuraminidase__InfluenzaA__AAZ80021
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcgccguggucaugaccgacggguccgccagcggcaaggcggacaccaagauccucuucaucgaggagggcaagaucgugcacaccagcaagcuguccgggagcgcccagcacguggaggagugcuccugcuacccccgguaccccggcauccgcugcgucugccgggacaacuggaaggggagcaaccgcccgaucguggacaucaacaucaaggacuacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagcugcgguccggcuacgagaccuucaaggugaucgagggguggagcaaccccaacuccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggacguccaacagcaucguggucuucugcggcaccuccgggaccuacggcaccgggagcuggccggacggcgccgacaucaaccugaugcccaucuga

SEQ ID NO: 75379 - RNA, 1410 nt, Artificial Sequence
  derived and/or modified sequence opt1 from neuraminidase__InfluenzaA__AAZ83245
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcaacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacgacaccguccacgaccgcacccccuaccggacccugcucaugaacgagcugggcgugcccuuccaccugggcacgaagcaggucugcaucgccugguccagcuccagcugccacgacgggaaggccuggcuccacgugugcgugaccggcgacgacgagaacgcgaccgccuccuucaucuacaacgggcgccugguggacagcaucgucuccuggagcaagaagauccugcggacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgcuacccgggcguccggugcgugugccgcgacaacuggaagggguccaaccggcccaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaacccgaacagcaagcugcagaucaaccgccaggugaucguggaccgggacaaccgguccggcuacagcgggaucuucuccgucgagggcaagagcugcaucaaccgcugcuucuacguggagcucauccgggggcgcaaccaggagaccgaggugcuguggaccagcaacuccaucgucguguucugcggcaccagcggcacguacgggaccggcuccuggcccgacggggccgacaucaaccugaugcccaucuga

SEQ ID NO: 75380 - RNA, 1413 nt, Artificial Sequence
  derived and/or modified sequence opt1 from neuraminidase__InfluenzaA__AAZ83256
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggaucgacagcgacaccgccaacugguccuggcccgacggcgccgagcugcccuucaccaucgacaaguga

SEQ ID NO: 75381 - RNA, 1410 nt, Artificial Sequence; identical to SEQ ID NO: 75287
  derived and/or modified sequence opt1 from neuraminidase__InfluenzaA__AAZ83269

SEQ ID NO: 75382 - RNA, 1410 nt, Artificial Sequence; identical to SEQ ID NO: 75287
  derived and/or modified sequence opt1 from neuraminidase__InfluenzaA__AAZ83280

SEQ ID NO: 75383 - RNA, 1410 nt, Artificial Sequence; identical to SEQ ID NO: 75261
  derived and/or modified sequence opt1 from neuraminidase__InfluenzaA__AAZ83291

SEQ ID NO: 75384 - RNA, 1413 nt, Artificial Sequence
  derived and/or modified sequence opt1 from neuraminidase__InfluenzaA__AAZ83302
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaaggccagcgucacccuggccggcaacuccagccugugcuccaucagcggcugggccaucuacaccaaggacaacuccauccggaucgggagcaagggcgacguguucgugauccgcgagccguucaucuccugcagccacuccgagugccggaccuucuuccucacgcagggggcccugcugaacgacaagcacagcaacggcaccgucaaggaccgcucccccuaccgggcgcucaugagcugcccccugggggaggcccccagcccguacaacuccaaguucgagagcguggccugguccgccagcgcgugccacgacggcaugggcuggcugaccaucgggaucuccggccccgacaacggggccguggccguccucaaguacaacggcaucaucaccgagacgaucaagagcuggaagaagcagauccugcgcacccaggaguccgagugcgugugcgugaacggcagcugcuucaccaucaugaccgacgggcccuccaacggcgccgccagcuacaagaucuucaagaucgagaaggggaaggucacgaaguccaucgagcugaacgcgcccaacuuccacuacgaggagugcagcugcuacccggacaccggcaccgugaugugcgugugccgggacaacuggcacggguccaaccgccccugggucagcuucaaccagaaccucgacuaccagaucggcuacaucugcuccggcguguucggggacaacccccggcccaaggacggcgaggggagcugcaacccggugaccgucgacggcgccaacggggugaagggcuucuccuacaaguacggcaacgggguguggaucggccgcaccaagagcaaccggcugcgcaagggguucgagaugaucugggaccccaacggcuggacggacaccgacuccgacuucagcgucaagcaggacgugguggccaucaccgacuggagcggguacuccggcagcuucguccagcaccccgagcugacgggccucgacugcauccggcccugcuucuggguggagcugguccgcgggcugccgaaggagaacaccaccaucuggaccuccggcagcuccaucagcuucugcggggugaacuccgacacggccaacuggagcuggcccgacggcgccgagcuccccuucaccaucgacaaguga

SEQ ID NO: 75385 - RNA, 1410 nt, Artificial Sequence
  derived and/or modified sequence opt1 from neuraminidase__InfluenzaA__AAZ83315
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggccgggcgaacaccaagauccuguucaucgaggaggggaagaucauccacaucagccagcucagcggcuccgcccagcacgucgaggagugcagcugcuacccccgcuaccccggggugcggugcgugugccgcgacaacuggaagggcuccaaccggcccaucgucgacaucaacgugaaggacuacagcaucgccuccagcuacgugugcuccggccuggucggggacacgccgcgcaagaacgacagcuccagcuccagccacugccugaaccccaacaacgaggagggcgggcacggcgugaaggggugggccuucgacgacggcaacgacguguggaugggccggaccaucuccgagaaguuccgcagcggguacgagaccuucaaggucaucgagggcugguccaagcccaacagcaagcuccagaucaaccgccaggugaucgucgaccgggacaaccgguccggguacagcggcaucuucuccguggagggcaagagcugcaucaaccgcugcuucuacguggagcugauccgggggcgcaagcaggagaccgaggucugguggacgagcaacuccaucgugguguucugcggcaccagcgggaccuacggcaccggguccuggcccgacggcgccgacaucaaccugaugccgaucuga

SEQ ID NO: 75386 - RNA, 1410 nt, Artificial Sequence
  derived and/or modified sequence opt1 from neuraminidase__InfluenzaA__AAZ83326
augaaccccaaccagaagaucaucaccaucggcagcgugucccugaccaucgccacgaucugcuuccucaugcagaucgccauccuggucaccaccgugacccugcacuucaagcaguacgagugcgacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggccgggcggacaccaagauccuguucaucgaggaggggaagaucauccacaucagccagcucagcggcuccgcccagcacgucgaggagugcagcugcuacccccgcuaccccggggugcggugcgugugccgcgacaacuggaagggcuccaaccggcccaucgucgacaucaacgugaaggacuacagcaucguguccagcuacgucugcuccggccuggugggggacacgccgcgcaagaacgacagcuccagcuccagccacugccugaaccccaacaacgaggagggcgggcacggcgugaaggggugggccuucgacgacggcaacgacgucuggaugggccggaccaucuccgagaaguuccgcagcggguacgagaccuucaaggugaucgagggcugguccaagcccaacagcaagcuccagaucaaccggcaggucaucguggaccgcgacaaccgguccggguacagcggcaucuucuccguggagggcaagagcugcaucaaccgcugcuucuacgucgagcugauccgggggcgcaagcaggagaccgaggugugguggacgagcaacuccaucguggucuucugcggcaccagcgggaccuacggcaccggguccuggcccgacggcgccgacaucaaccugaugccgaucuga

SEQ ID NO: 75387 - RNA, 1410 nt, Artificial Sequence
  derived and/or modified sequence opt1 from neuraminidase__InfluenzaA__AAZ83374
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcaccggcuacgagaccuucaaggucaucgaggggugguccaaccccaacagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgacaucaaccugaugcccaucuga

SEQ ID NO: 75388 - RNA, 1410 nt, Artificial Sequence; identical to SEQ ID NO: 75354
  derived and/or modified sequence opt1 from neuraminidase__InfluenzaA__AAZ83385

SEQ ID NO: 75389 - RNA, 1413 nt, Artificial Sequence
  derived and/or modified sequence opt1 from neuraminidase__InfluenzaA__AAZ85129
augaacaccaaccagaagaucaucaccaucggcagcaucuccaucgccaucgggaucaucagccugaugcuccagaucggcaacaucaucuccaucugggccagccacuccauccagacggggagccagaaccacaccggcgugugcaaccagcgcaucaucaccuacgagaacuccaccugggucaaccacacguacgugaacaucaacaacaccaacgugaucgcggggaaggacaagaccagcgucacccuggccggcaacuccagccugugcuccaucagcggcugggccaucuacacgaaggacaacuccauccggaucgggagcaagggcgacguguucgugauccgcgagcccuucaucuccugcagccaccucgagugccggaccuucuuccugacccagggggcccugcucaacgacaagcacuccaacggcaccgucaaggaccgcagcccguaccgggcccugauguccugcccccugggggaggcgcccagccccuacaacagcaaguucgaguccguggccuggagcgccuccgccugccacgacggcaugggcuggcucacgaucgggaucagcggcccggacaacggggcgguggccguccugaaguacaacggcaucaucaccgagaccaucaaguccuggaagaagcagauccugcgcacccaggagagcgagugcgugugcgugaacggcuccugcuucacgaucaugaccgacgggcccagcaacggcgccgccuccuacaagaucuucaagaucgagaaggggaaggucaccaagagcaucgagcucaacgcccccaacuuccacuacgaggagugcuccugcuaccccgacaccggcacggugaugugcgugugccgggacaacuggcacgggagcaaccgcccgugggucuccuucaaccagaaccuggacuaccagaucggcuacaucugcagcggcguguucggggacaacccccggcccaaggacggcgagggguccugcaaccccgugaccgucgacggcgcgaacggggugaagggcuucagcuacaaguacggcaacgggguguggaucggccgcaccaaguccaaccggcugcgcaagggguucgagaugaucugggacccgaacggcuggaccgacacggacagcgacuucuccgucaagcaggacgugguggccaucaccgacuggagcggguacagcggcuccuucguccagcaccccgagcucaccggccuggacugcauccggcccugcuucuggguggagcugguccgcgggcuccccaaggagaacaccacgaucuggaccagcggcuccagcaucuccuucugcggggugaacagcgacaccgccaacugguccuggccggacggcgccgagcugcccuucaccaucgacaaguga

SEQ ID NO: 75390 - RNA, 1410 nt, Artificial Sequence
  derived and/or modified sequence opt1 from neuraminidase__InfluenzaA__ABA06513
augaaccccaaccagaagaucaucaccaucggcagcgugucccugaccaucgccacgaucugcuuccucacccagaucgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggaccaagcaggucugcaucgccugguccagcuccagcugccacgacggcaaggcguggcugcacgugugcgugaccggggacgacaagaacgccaccgccuccuucaucuacaacggccgccugguggacagcaucggguccuggagcaagaagauccuccggacgcaggaguccgagugcgucugcaucaacgggaccugcaccguggugaugaccgacggcagcgccuccgggaaggcggacacgaagauccuguucaucgaggagggcaagaucguccacaccagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcggccacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccgggacaaccgguccggcuacagcgggaucuucuccgucgagggcaagagcugcaucaaccgcugcuucuacguggagcugauccggggccgcaaccaggagaccgaggugcucuggaccagcaacuccaucgucguguucugcgggaccagcggcacguacgggaccggcuccuggccggacggggccgacaucaaccugaugcccaucuga

SEQ ID NO: 75391 - RNA, 1410 nt, Artificial Sequence; identical to SEQ ID NO: 75390
  derived and/or modified sequence opt1 from neuraminidase__InfluenzaA__ABA06545

SEQ ID NO: 75392 - RNA, 1413 nt, Artificial Sequence
  derived and/or modified sequence opt1 from neuraminidase__InfluenzaA__ABA08478
augaacaccaaccagaagaucaucaccaucggcagcaucuccaucgccaucgggaucaucagccugaugcuccagaucggcaacaucaucuccaucugggccagccacuccauccagacggggagccagaaccacaccggcaucugcaaccagcgcaucaucaccuacgagaacuccaccugggugaaccacacguacgucaacaucaacaacaccaacgugguggcggggaaggacaagaccagcgucacccuggccggcaacuccagccugugcuccaucagcggcugggccaucuacacgaaggacaacuccauccggaucgggagcaagggcgacguguucgugauccgcgagcccuucaucuccugcagccaccucgagugccggaccuucuuccugacccagggggcccugcucaacgacaagcacuccaacggcaccgucaaggaccgcagcccguaccgggcccugauguccugcccccugggggaggcgcccagccccuacaacagcaaguucgaguccguggccuggagcgccuccgccugccacgacggcaugggcuggcucacgaucgggaucagcggcccggacaacggggcgguggccguccugaaguacaacggcaucaucaccgagaccaucaaguccuggaagaagcgcauccugcggacccaggagagcgagugcgugugcgugaacggcuccugcuucacgaucaugaccgacgggcccagcaacggcgccgccuccuacaagaucuucaagaucgagaaggggaaggucaccaagagcaucgagcucaacgcccccaacuuccacuacgaggagugcuccugcuaccccgacaccggcacggugaugugcgugugccgcgacaacuggcacgggagcaaccggccgugggucuccuucaaccagaaccuggacuaccagaucggcuacaucugcagcggcguguucggggacaacccccgccccaaggacggcaagggguccugcaaccccgugaccgucgacggcgcggacggggugaagggcuucagcuacaaguacggcaacgggguguggaucggccggaccaaguccaaccgccugcggaagggguucgagaugaucugggacccgaacggcuggaccgacacggacagcgacuucuccgucaagcaggacgugguggccaucaccgacuggagcggguacagcggcuccuucguccagcaccccgagcucaccggccuggacugcauccgccccugcuucuggguggagcugguccgggggcucccccgcgagaacaccacgaucuggaccagcggcuccagcaucuccuucugcgggguggacagcgacaccgccaacugguccuggccggacggcgccgagcugcccuucaccaucgacaaguga

SEQ ID NO: 75393 - RNA, 1410 nt, Artificial Sequence; identical to SEQ ID NO: 75390
  derived and/or modified sequence opt1 from neuraminidase__InfluenzaA__ABA08511

SEQ ID NO: 75394 - RNA, 1413 nt, Artificial Sequence
  derived and/or modified sequence opt1 from neuraminidase__InfluenzaA__ABA12699
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 75395 - RNA, 1413 nt, Artificial Sequence; identical to SEQ ID NO: 75394
  derived and/or modified sequence opt1 from neuraminidase__InfluenzaA__ABA12710

SEQ ID NO: 75396 - RNA, 1413 nt, Artificial Sequence
  derived and/or modified sequence opt1 from neuraminidase__InfluenzaA__ABA12721
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgggaagggcaaggucaccaagagcaucgagcucaacgcccccaacuuccacuacgaggagugcuccugcuacccggacaccgggaccgugaugugcgugugccgggacaacuggcacggcagcaaccgccccugggucuccuucaaccagaaccuggacuaccagaucggcuacaucugcagcgggguguucggcgacaacccccggccccgcgacggggagggcuccugcaacccggugacggucgacggggcgaacggcgugaagggcuucagcuacaaguacgggaacggcguguggaucgggcggaccaaguccaaccgccugcggaagggcuucgagaugaucugggaccccaacggguggaccgacaccgacagcgacuucuccgucaagcaggacgugguggccaucacggacuggagcggcuacagcggcuccuucguccagcaccccgagcucaccgggcuggacugcauccgccccugcuucuggguggagcugguccggggccucccgcgcgagaacaccaccaucuggacgagcggguccagcaucuccuucugcggcgugaacagcgacaccgccaacugguccuggcccgacggcgccgagcugcccuucaccaucgacaaguga

SEQ ID NO: 75397 - RNA, 1413 nt, Artificial Sequence; identical to SEQ ID NO: 75394
  derived and/or modified sequence opt1 from neuraminidase__InfluenzaA__ABA12732

SEQ ID NO: 75398 - RNA, 1410 nt, Artificial Sequence; identical to SEQ ID NO: 75335
  derived and/or modified sequence opt1 from neuraminidase__InfluenzaA__ABA12743

SEQ ID NO: 75399 - RNA, 1410 nt, Artificial Sequence; identical to SEQ ID NO: 75351
  derived and/or modified sequence opt1 from neuraminidase__InfluenzaA__ABA12754

SEQ ID NO: 75400 - RNA, 1410 nt, Artificial Sequence; identical to SEQ ID NO: 75354
  derived and/or modified sequence opt1 from neuraminidase__InfluenzaA__ABA12765

SEQ ID NO: 75401 - RNA, 1410 nt, Artificial Sequence; identical to SEQ ID NO: 75126
  derived and/or modified sequence opt1 from neuraminidase__InfluenzaA__ABA12776

SEQ ID NO: 75402 - RNA, 1410 nt, Artificial Sequence; identical to SEQ ID NO: 75335
  derived and/or modified sequence opt1 from neuraminidase__InfluenzaA__ABA12786

SEQ ID NO: 75403 - RNA, 1410 nt, Artificial Sequence; identical to SEQ ID NO: 75354
  derived and/or modified sequence opt1 from neuraminidase__InfluenzaA__ABA18029

SEQ ID NO: 75404 - RNA, 1413 nt, Artificial Sequence
  derived and/or modified sequence opt1 from neuraminidase__InfluenzaA__ABA18040
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgaaggagaacaccaccaucuggacgagcggcuccagcaucuccuucugcggggugaacagcgacaccgccaacugguccuggcccgacggcgccgagcugcccuucaccaucgacaaguga

SEQ ID NO: 75405 - RNA, 1410 nt, Artificial Sequence
  derived and/or modified sequence opt1 from neuraminidase__InfluenzaA__ABA18126
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacauguggauggggcggaccaucagcgagaagcugcgcuccggcuacgagaccuucaaggugaucgagggguggagcaagcccaacuccaagcuccagaucaaccggcaggucaucguggagcgcggcaaccggagcggguacuccggcaucuucagcguggagggcaaguccugcaucaaccgcugcuucuacgucgagcugauccgggggcgcaaggaggagaccgaggugugguggaccagcaacagcaucguggucuucugcggcaccuccgggaccuacggcacggggagcuggccggacggcgccgacaucaaccugaugcccaucuga

SEQ ID NO: 75406 - RNA, 1413 nt, Artificial Sequence; identical to SEQ ID NO: 75394
  derived and/or modified sequence opt1 from neuraminidase__InfluenzaA__ABA18148

SEQ ID NO: 75407 - RNA, 1410 nt, Artificial Sequence
  derived and/or modified sequence opt1 from neuraminidase__InfluenzaA__ABA18159
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcgccguggucaugaccgacggguccgccagcggcaaggcggacaccaagauccucuucaucgaggagggcaagaucgugcacaccagcaagcuguccgggagcgcccagcacguggaggagugcuccugcuacccccgcuaccccggcauccggugcgucugccgcgacaacuggaaggggagcaaccggccgaucguggacgugaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggacguccaacagcaucgucguguucugcggcaccuccgggaccuacggcaccgggagcuggccggacggcgccgacaucaaccugaugcccaucuga

SEQ ID NO: 75408 - RNA, 1410 nt, Artificial Sequence; identical to SEQ ID NO: 75335
  derived and/or modified sequence opt1 from neuraminidase__InfluenzaA__ABA26703

SEQ ID NO: 75409 - RNA, 1410 nt, Artificial Sequence; identical to SEQ ID NO: 75335
  derived and/or modified sequence opt1 from neuraminidase__InfluenzaA__ABA26714

SEQ ID NO: 75410 - RNA, 1410 nt, Artificial Sequence; identical to SEQ ID NO: 75335
  derived and/or modified sequence opt1 from neuraminidase__InfluenzaA__ABA26736

SEQ ID NO: 75411 - RNA, 1410 nt, Artificial Sequence; identical to SEQ ID NO: 75335
  derived and/or modified sequence opt1 from neuraminidase__InfluenzaA__ABA26747

SEQ ID NO: 75412 - RNA, 1410 nt, Artificial Sequence; identical to SEQ ID NO: 75335
  derived and/or modified sequence opt1 from neuraminidase__InfluenzaA__ABA26758

SEQ ID NO: 75413 - RNA, 1410 nt, Artificial Sequence; identical to SEQ ID NO: 75335
  derived and/or modified sequence opt1 from neuraminidase__InfluenzaA__ABA26769

SEQ ID NO: 75414 - RNA, 1410 nt, Artificial Sequence; identical to SEQ ID NO: 75335
  derived and/or modified sequence opt1 from neuraminidase__InfluenzaA__ABA26780

SEQ ID NO: 75415 - RNA, 1410 nt, Artificial Sequence; identical to SEQ ID NO: 75335
  derived and/or modified sequence opt1 from neuraminidase__InfluenzaA__ABA26791

SEQ ID NO: 75416 - RNA, 1410 nt, Artificial Sequence; identical to SEQ ID NO: 75335
  derived and/or modified sequence opt1 from neuraminidase__InfluenzaA__ABA26802

SEQ ID NO: 75417 - RNA, 1413 nt, Artificial Sequence
  derived and/or modified sequence opt1 from neuraminidase__InfluenzaA__ABA42250
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcgacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 75418 - RNA, 1413 nt, Artificial Sequence; identical to SEQ ID NO: 75404
  derived and/or modified sequence opt1 from neuraminidase__InfluenzaA__ABA42261

SEQ ID NO: 75419 - RNA, 1410 nt, Artificial Sequence
  derived and/or modified sequence opt1 from neuraminidase__InfluenzaA__ABA42272
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggacauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaagcugcgccugggcuacgagaccuucaaggucaucgagggguggagcaaccccaacuccaagcuccagaucaaccgccaggugaucguggagcggggcaaccggagcggguacuccggcaucuucagcgucgaggggaaguccugcaucaaccgcugcuucuacguggagcugauccggggccgcaaggaggagaccgaggugcuguggaccagcaacagcaucgucguguucugcggcaccuccgggacguacggcaccgggagcuggccggacggcgccgacaucaaccucaugcccaucuga

SEQ ID NO: 75420 - RNA, 1410 nt, Artificial Sequence; identical to SEQ ID NO: 75335
  derived and/or modified sequence opt1 from neuraminidase__InfluenzaA__ABA42294

SEQ ID NO: 75421 - RNA, 1410 nt, Artificial Sequence; identical to SEQ ID NO: 75162
  derived and/or modified sequence opt1 from neuraminidase__InfluenzaA__ABA42305

SEQ ID NO: 75422 - RNA, 1410 nt, Artificial Sequence; identical to SEQ ID NO: 75172
  derived and/or modified sequence opt1 from neuraminidase__InfluenzaA__ABA42316

SEQ ID NO: 75423 - RNA, 1413 nt, Artificial Sequence
  derived and/or modified sequence opt1 from neuraminidase__InfluenzaA__ABA42327
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 75424 - RNA, 1410 nt, Artificial Sequence; identical to SEQ ID NO: 75157
  derived and/or modified sequence opt1 from neuraminidase__InfluenzaA__ABA42338

SEQ ID NO: 75425 - RNA, 1410 nt, Artificial Sequence
  derived and/or modified sequence opt1 from neuraminidase__InfluenzaA__ABA42349
augaaccccaaccagaagaucaucaccaucggcagcgugucccugaccaucgccacgaucugcuuccucaugcagaucgccauccuggucaccaccgugacccugcacuucaagcaguacgagugcgacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggcaagcugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggaccagcaacagcaucgucguguucugcggcaccuccgggaccuacggcacggggagcuggccggacggcgccgacaucaaccugaugcccaucuga

SEQ ID NO: 75426 - RNA, 1410 nt, Artificial Sequence; identical to SEQ ID NO: 75162
  derived and/or modified sequence opt1 from neuraminidase__InfluenzaA__ABA42360

SEQ ID NO: 75427 - RNA, 1410 nt, Artificial Sequence; identical to SEQ ID NO: 75157
  derived and/or modified sequence opt1 from neuraminidase__InfluenzaA__ABA42371

SEQ ID NO: 75428 - RNA, 1410 nt, Artificial Sequence; identical to SEQ ID NO: 75172
  derived and/or modified sequence opt1 from neuraminidase__InfluenzaA__ABA42382

SEQ ID NO: 75429 - RNA, 1410 nt, Artificial Sequence; identical to SEQ ID NO: 75157
  derived and/or modified sequence opt1 from neuraminidase__InfluenzaA__ABA42393

SEQ ID NO: 75430 - RNA, 1410 nt, Artificial Sequence
  derived and/or modified sequence opt1 from neuraminidase__InfluenzaA__ABA42404
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucgucaacaucagcacccugcccgggagcgcccagcacguggaggagugcuccugcuacccccgguacccgggcgugcgcugcgucugccgggacaacuggaagggcagcaaccgccccaucguggacaucaacgugaaggacuacuccaucgucagcuccuacgugugcagcgggcucgugggcgacacgccccggaagaacgacuccuucagcuccagccacugccuggaccccaacaacgaggagggcggccacggggucaagggcugggccuucgacgacggcaacgacguguggauggggcgcaccaucuccgagaagcugcggagcggcuacgagaccuucaaggucaucgaggggugguccaagccgaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggacguccaacagcaucgucguguucugcggcaccagcgggaccuacggcaccggguccuggcccgacggcgccgacaucaaccugaugcccaucuga

SEQ ID NO: 75431 - RNA, 1410 nt, Artificial Sequence; identical to SEQ ID NO: 75172
  derived and/or modified sequence opt1 from neuraminidase__InfluenzaA__ABA42415

SEQ ID NO: 75432 - RNA, 1410 nt, Artificial Sequence; identical to SEQ ID NO: 75179
  derived and/or modified sequence opt1 from neuraminidase__InfluenzaA__ABA42446

SEQ ID NO: 75433 - RNA, 1410 nt, Artificial Sequence
  derived and/or modified sequence opt1 from neuraminidase__InfluenzaA__ABA42457
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgaguccaagagcugcaucaaccggugcuucuacguggagcugauccgcggccggaaggaggagaccgaggugugguggaccagcaacuccaucgucguguucugcgggaccagcggcaccuacgggacgggcuccuggccggacggggccgacaucaaccugaugcccaucuga

SEQ ID NO: 75434 - RNA, 1410 nt, Artificial Sequence; identical to SEQ ID NO: 75179
  derived and/or modified sequence opt1 from neuraminidase__InfluenzaA__ABA42468

SEQ ID NO: 75435 - RNA, 1410 nt, Artificial Sequence
  derived and/or modified sequence opt1 from neuraminidase__InfluenzaA__ABA42479
augaaccccaaccagaagaucaucaccaucggcagcgugucccugaccaucgccacgaucugcuuccucaugcagaucgccauccuggucaccaccgugacccugcacuucaagcaguacgagugcgacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggacgggggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 75436 - RNA, 1410 nt, Artificial Sequence
  derived and/or modified sequence opt1 from neuraminidase__InfluenzaA__ABA42490
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcaagcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucaagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 75437 - RNA, 1410 nt, Artificial Sequence; identical to SEQ ID NO: 75179
  derived and/or modified sequence opt1 from neuraminidase__InfluenzaA__ABA42501

SEQ ID NO: 75438 - RNA, 1410 nt, Artificial Sequence
  derived and/or modified sequence opt1 from neuraminidase__InfluenzaA__ABA42512
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccccaccaacaccacgaucgagaaggagaucugcccgaagcuggcggaguaccggaacugguccaagccccagugcaacaucaccggguucgcccccuucagcaaggacaacuccauccgccugagcgccggcggggacaucugggugacccgggagcccuacguguccugcgacccggacaagugcuaccaguucgcccucggccaggggaccacgcugaacaacggccacagcaacgacaccguccacgaccgcacccccuaccggacccugcucaugaacgagcugggcgugcccuuccaccuggggacgaagcaggucugcaucgccugguccagcuccagcugccacgacggcaaggcguggcuccacgugugcgugaccggggacgacgagaacgccaccgccuccuucaucuacaacggccgccugguggacagcaucggguccuggagcaagaagauccugcggacccaggaguccgagugcgucugcaucaacggcacgugcaccguggugaugaccgacggcagcgccuccgggaaggcggacaccaagauccucuucaucgaggagggcaagaucguccacacgagcagccuguccgggagcgcccagcacguggaggagugcuccugcuacccccgcuacccgggcgugcggugcgucugccgcgacaacuggaagggcagcaaccggcccaucguggacaucaacgugaaggacuacuccaucgucagcuccuacgugugcagcgggcuggugggcgacacgccccgcaagaacgacuccagcuccagcucccacugccucgaccccaacaacgaggagggcgggcacggggucaagggcugggccuucgacgacggcaacgacguguggauggggcggaccaucagcgagaagcugcgcuccggcuacgagaccuucaaggucaucgagggguggagcaagccgaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggaccuacggcacggggagcuggcccgacggcgccgacaucaaccugaugcccaucuga

SEQ ID NO: 75439 - RNA, 1410 nt, Artificial Sequence; identical to SEQ ID NO: 75069
  derived and/or modified sequence opt1 from neuraminidase__InfluenzaA__ABA42523

SEQ ID NO: 75440 - RNA, 1410 nt, Artificial Sequence; identical to SEQ ID NO: 75069
  derived and/or modified sequence opt1 from neuraminidase__InfluenzaA__ABA42534

SEQ ID NO: 75441 - RNA, 1410 nt, Artificial Sequence; identical to SEQ ID NO: 75261
  derived and/or modified sequence opt1 from neuraminidase__InfluenzaA__ABA42545

SEQ ID NO: 75442 - RNA, 1410 nt, Artificial Sequence
  derived and/or modified sequence opt1 from neuraminidase__InfluenzaA__ABA42556
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggaggccgaggugcucuggaccagcaacuccaucgucguguucugcggcaccagcgggaccuacggcaccggguccuggccggacggcgccgacaucaaccugaugcccaucuga

SEQ ID NO: 75443 - RNA, 1410 nt, Artificial Sequence; identical to SEQ ID NO: 75069
  derived and/or modified sequence opt1 from neuraminidase__InfluenzaA__ABA42567

SEQ ID NO: 75444 - RNA, 1410 nt, Artificial Sequence
  derived and/or modified sequence opt1 from neuraminidase__InfluenzaA__ABA42931
augaaccccaaccagaagaucaucaccaucggcagcgugucccugaccaucgccacgaucugcagccucaugcagaucgccauccuggucaccaccgugacccugcacuucaagcaguacgagugcaacuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaacaucaccggguucgcccccuucuccaaggacaacagcauccgccucuccgccggcggggacaucugggugacccgggagcccuacgugagcugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggagcuccagcuccugccacgacggcaaggcguggcugcacgugugcgugaccggggacgacgagaacgccaccgccagcuucaucuacaacggccgccugguggacuccaucgggagcugguccaagaagauccuccggacccaggagagcgagugcgucugcaucaacggcacgugcaccguggugaugaccgacggcuccgccagcgggaaggcggacaccaagauccuguucaucgaggagggcaagaucguccacacgagccugcucuccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcuggugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcuccgcuccggcuacgagaccuucaaggucaucgagggguggagcaagcccaacuccaagcugcagaucaaccgccaggugaucguggaccggggcaaccggagcggguacuccggcaucuucagcgucgagggcaagagcugcaucaaccgcugcuucuacguggagcugauccgggggcgcaagcaggagaccgaggugcucuggaccuccaacagcaucgucguguucugcggcaccuccgggaccuacggcacggggagcuggccggacggcgccgacaucaaccugaugcccaucuga

SEQ ID NO: 75445 - RNA, 1410 nt, Artificial Sequence; identical to SEQ ID NO: 75069
  derived and/or modified sequence opt1 from neuraminidase__InfluenzaA__ABA42942

SEQ ID NO: 75446 - RNA, 1410 nt, Artificial Sequence; identical to SEQ ID NO: 75069
  derived and/or modified sequence opt1 from neuraminidase__InfluenzaA__ABA42981

SEQ ID NO: 75447 - RNA, 1410 nt, Artificial Sequence; identical to SEQ ID NO: 75157
  derived and/or modified sequence opt1 from neuraminidase__InfluenzaA__ABA42992

SEQ ID NO: 75448 - RNA, 1413 nt, Artificial Sequence
  derived and/or modified sequence opt1 from neuraminidase__InfluenzaA__ABA43192
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucauccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccgagacgaucaaguccuggaagaagcagauccugcgcacccaggagagcgagugcgugugcgugaacggcuccugcuucaccaucaugaccgacgggcccagcaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugaccgucgacggcgcgaacggggugaagggcuucagcuacaaguacggcaacgggguguggaucggccgcacgaaguccaaccggcugcgcaagggguucgagaugaucugggaccccaacggcuggaccgacaccgacagcgacuucuccgucaagcaggacguggugagcaucaccgacuggagcggguacuccggcagcuucguccagcaccccgagcucacgggccuggacugcauccggcccugcuucuggguggagcugguccgcgggcucccgaaggagaacaccaccaucuggaccuccggcagcuccaucagcuucugcggggugaacuccgacacggccaacuggagcuggcccgacggcgccgagcugcccuucaccaucgacaaguga

SEQ ID NO: 75449 - RNA, 1410 nt, Artificial Sequence; identical to SEQ ID NO: 75354
  derived and/or modified sequence opt1 from neuraminidase__InfluenzaA__ABA43203

SEQ ID NO: 75450 - RNA, 1410 nt, Artificial Sequence
  derived and/or modified sequence opt1 from neuraminidase__InfluenzaA__ABA43339
augaaccccaaccagaagaucaucaccaucggcagcgugucccugagcaucgccaccaucugcuuccucaugcagaucgccauccuggucacgaccgugacccugcacuucaagcaguacgagugcuccagcccgcccaacaaccaggugaugcccugcgagcccaccaucaucgagcgcaacaucacggagaucgucuaccucaccaacaccaccaucgagaaggagaucugcccgaagcugguggaguaccggaacugguccaagccccagugcaagaucacgggguucgcgcccuucagcaaggacaacuccauccgccugagcgccggcggggacaucugggugacccgggagcccuacgucuccugcgacccgggcaagugcuaccaguucgcccucgggcagggcaccacccugaacaaccgccacagcaacgacacggugcacgaccggacccccuaccgcacccugcucaugaacgagcugggcgugcccuuccaccuggggaccaagcaggucugcauggccugguccagcuccagcugccacgacggcaaggccuggcuccacgugugcgugacggggcacgacgagaacgcgaccgccuccuucaucuacgacggccggcuggucgacagcaucggguccuggagcaagaacauccugcgcacccaggaguccgagugcgugugcaucaacgggaccugcacgguggucaugaccgacggcagcgccagcgagcgggccgacaccaagauccucuucaucgaggagggcaagaucgugcacaucagcccccuguccggcuccgcgcagcacguggaggagugcagcugcuacccgcgcuaccccgggguccggugcgugugccgcgacaacuggaagggcuccaaccggcccaucguggacaucaacgucaaggacuacagcaucguguccagcuacgugugcuccggccuggucggggacacgccccgcaagaacgaccggagcuccagcuccuacugccgcaacccgaacaacgagaagggcagccacggggugaagggcugggccuucgacgacgggaacgacgucuggaugggccggaccaucggcgaggagcuccgcuccggguacgagaccuucaaggugaucggcggguggagcacccccaacuccaagcugcagaucaaccgccaggugaucgucgacagcggcaaccgguccggguacagcggcaucuucagcguggagggcaaguccugcaucaaccggugcuucuacguggagcugauccgcgggcgcaagcaggagacccgggucugguggacgagcaacuccaucgugguguucugcggcaccagcgggaccuacggcaccggguccuggcccgacggcgccgacaucaaccucaugcccaucuga

SEQ ID NO: 75451 - RNA, 1410 nt, Artificial Sequence
  derived and/or modified sequence opt1 from neuraminidase__InfluenzaA__ABA54916
augaaccccaaccagaagaucaucaccaccggcagcaucugcauggugaucgggauggucucccugaugcuccagaucggcaacaucaucagcaucugggugucccacagcauccagacggggacccagcaccgcgccgagccgugcaaccgguccaucaucaacuacgagaacaacaccugggugaaccagaccuacgucaagaucagcaacacgaacuuccugaccgagaaggccguggcguccgugcgccuggucggcaacagcucccucugccccaucagcgggugggccguguacuccaaggacaacagcauccggaucggcuccaagggcgacguguucgucauccgcgagcccuucaucagcugcucccaccuggagugccggaccuucuuccugacccagggggcccuccugaacgacaagcacagcaacggcacggugaaggaccgcucccccuaccggacccugaugagcugcccggugggggaggcccccucccccuacaacagccgcuucgagagcgucgccugguccgcgagcgccugccacgacggcaccuccuggcucaccaucgggaucagcggccccgacaacggcgccguggccgugcugaaguacaacgggaucaucacggacaccaucaaguccuggcggaacaacauccugcgcgcgcaggagagcgagugcgccugcgucaacggcuccugcuucaccgugaugaccgacgggccgagcaacggccaggccuccuacaagaucuucaagaucgagaagggcaagguggucaagagcguggagcucaacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgugagccccaacggcgcguacggggucaagggcuucuccuucaaguacgggaacggcguguggaucggccgcaccaagagcaccaacucccggagcggguucgagaugaucugggacccgaacggcuggacggggaccgacagcaacuucuccgucaagcaggacaucguggccaucaccgacuggagcggcuacuccgggagcuucgugcagcaccccgagcugaccggccucgacugcauccgccccugcuucugggucgagcugauccggggccgccccaaggaguccacgaucuggaccagcggguccagcaucuccuucugcggcgugaacagcgacaccguggggugguccuggccggacggcgccgagcugcccuucaccaucgacaaguga

SEQ ID NO: 75452 - RNA, 1413 nt, Artificial Sequence
  derived and/or modified sequence opt1 from neuraminidase__InfluenzaA__ABA87048
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaaccgggccgccuccuacaagaucuucaagaucgagaagggcaaggucaccaagagcguggagcucaacgcccccaacuuccacuacgaggagugcuccugcuacccggacaccgggaccgugaugugcgucugccgcgacaacuggcacggcagcaaccggcccuggguguccuucaaccagaaccuggacuaccagaucggguacaucugcagcggcguguucggcgacaacccccgccccaaggacggggagggcuccugcaacccggucacgguggacggggcgaacggcgugaagggguucagcuacaaguacggcaacggcgucuggaucgggcggaccaaguccaaccgccugcggaagggcuucgagaugaucugggaccccaacggguggaccgacaccgacagcgacuucuccgugaagcaggacguggucgccaucacggacuggagcggcuacagcggguccuucgugcagcaccccgagcucaccggccuggacugcauccgccccugcuucugggucgagcuggugcggggccucccgaaggagaacaccaccaucuggacgagcggguccagcaucuccuucugcggcgugaacagcgacaccgccaacugguccuggcccgacggggccgagcugcccuucaccaucgacaaguga

SEQ ID NO: 75453 - RNA, 1413 nt, Artificial Sequence
  derived and/or modified sequence opt1 from neuraminidase__InfluenzaA__ABA87060
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcaccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcagcccggugaccgucgacggcgccgacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggcgaucaccgacuggagcggguacuccggcagcuucguccagcaccccgagcucaccggccuggacugcauccgccccugcuucuggguggagcugguccgggggcucccgcgcgagaacaccacgaucuggaccuccggcagcuccaucagcuucugcgggguggacuccgacaccgccaacuggagcuggcccgacggcgccgagcugcccuucaccaucgacaaguga

SEQ ID NO: 75454 - RNA, 1413 nt, Artificial Sequence
  derived and/or modified sequence opt1 from neuraminidase__InfluenzaA__ABA87083
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagaagaucaucaccuacaagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcacguucuuccugacccagggggcccugcucaacgacaagcacuccaacggcaccgucaaggaccggagccccuaccgcgcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcggauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgcggacggggugaagggcuucagcuacaaguacggcaacgggguguggaucggccgcaccaaguccaaccggcugcgcaagggguucgagaugaucugggaccccaacggcuggaccgacaccgacagcgucuucuccgugaagcaggacguggucgccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggugaacagcgacaccgccaacugguccuggcccgacggcgccgagcugcccuucaccaucgacaaguga

SEQ ID NO: 75455 - RNA, 1413 nt, Artificial Sequence
  derived and/or modified sequence opt1 from neuraminidase__InfluenzaA__ABA87234
augaacagcaaccagaagaucaucaccaucggcuccaucagcaucgccaucgggaucaucucccugaugcuccagaucggcaacaucaucagcaucugggccucccacagcauccagaccgggucccagaaccacacgggcgugugcaaccagcgcaucaucaccuacgagaacagcaccugggucaaccacaccuacgugaacaucaacaacacgaacgugaucgcggggaaggacaagaccuccgucacccuggccggcaacagcucccugugcagcaucuccggcugggccaucuacaccaaggacaacagcauccggaucggguccaagggcgacguguucgugauccgcgagcccuucaucagcugcucccaccucgagugccggacguucuuccugacccagggggcccugcucaacgacaagcacagcaacggcaccgucaaggaccgcuccccguaccgggcccugaugagcugcccccugggggaggcgcccagccccuacaacuccaaguucgagagcguggccugguccgccagcgccugccacgacggcaugggcuggcucaccaucgggaucuccggcccggacaacggggcgguggccguccugaaguacaacggcaucaucacggagaccaucaagagcuggaagaagcagauccugcgcacccaggaguccgagugcgugugcgugaacggcagcugcuucaccaucaugacggacgggcccuccaacggcgccgccagcuacaagaucuucaagaucgagaaggggaaggucaucaaguccaucgagcucaacgcccccaacuuccacuacgaggagugcagcugcuaccccgacaccggcaccgugaugugcgugugccgggacaacuggcacggguccaaccgcccgugggucagcuucaaccagaaccuggacuaccagaucggcuacaucugcuccggcguguucggggacaacccccggcccaaggacggcgaggggagcugcaaccccgugaccgucgacggcgcgaacggggugaagggcuucuccuacaaguacggcaacgggguguggaucggccgcaccaagagcaaccggcugcgcaagggguucgagaugaucugggacccgaacggcuggacggacaccgacuccgacuucagcgucaagcaggacgugguggccaucaccgacuggagcggguacuccggcagcuucguccagcaccccgagcucacgggccuggacugcauccggcccugcuucuggguggagcugguccgcgggcuccccaaggagaacaccaccaucuggaccuccggcagcuccaucagcuucugcggggugaacuccgacacggccaacuggagcuggccggacggcgccgagcugcccuucaccaucgacaaguga

SEQ ID NO: 75456 - RNA, 1410 nt, Artificial Sequence; identical to SEQ ID NO: 75390
  derived and/or modified sequence opt1 from neuraminidase__InfluenzaA__ABB02784

SEQ ID NO: 75457 - RNA, 1413 nt, Artificial Sequence; identical to SEQ ID NO: 75394
  derived and/or modified sequence opt1 from neuraminidase__InfluenzaA__ABB02795

SEQ ID NO: 75458 - RNA, 1413 nt, Artificial Sequence; identical to SEQ ID NO: 75394
  derived and/or modified sequence opt1 from neuraminidase__InfluenzaA__ABB02806

SEQ ID NO: 75459 - RNA, 1413 nt, Artificial Sequence
  derived and/or modified sequence opt1 from neuraminidase__InfluenzaA__ABB02817
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcguggagcucaacgcccccaacuuccacuacgaggagugcuccugcuacccggacaccggcaccgugaugugcgucugccgggacaacuggcacgggagcaaccgccccuggguguccuucaaccagaaccuggacuaccagaucggcuacaucugcagcggcguguucggggacaacccccggcccaaggacggcgagggguccugcaacccggucacgguggacggcgcgaacggggugaagggcuucagcuacaaguacggcaacggggucuggaucggccgcaccaaguccaaccggcugcgcaagggguucgagaugaucugggaccccaacggcuggaccgacaccgacagcgacuucuccgugaagcaggacguggucgccaucacggacuggagcggguacagcggcuccuucgugcagcaccccgagcucaccggccuggacugcauccggcccugcuucugggucgagcuggugcgcgggcucccgaaggagaacaccaccaucuggacgagcggcuccagcaucuccuucugcggggugaacagcgacaccgccaacugguccuggcccgacggcgccgagcugcccuucaccaucgacaaguga

SEQ ID NO: 75460 - RNA, 1413 nt, Artificial Sequence; identical to SEQ ID NO: 75459
  derived and/or modified sequence opt1 from neuraminidase__InfluenzaA__ABB02828

SEQ ID NO: 75461 - RNA, 1410 nt, Artificial Sequence
  derived and/or modified sequence opt1 from neuraminidase__InfluenzaA__ABB02839
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccuggucgacuccaucgugagcugguccaaggagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 75462 - RNA, 1410 nt, Artificial Sequence
  derived and/or modified sequence opt1 from neuraminidase__InfluenzaA__ABB02850
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacgacaccguccacgaccgcacccccuaccggacccugcugaugaacgagcucggcgugcccuuccaccugggcacgaagcaggucugcaucgccuggagcuccagcuccugccacgacgggaaggccuggcugcacgugugcgugaccggcgacgacaagaacgcgaccgccagcuucaucuacaacgggcgccucguggacuccaucgucagcugguccaaggagauccugcggacccaggagagcgagugcgugugcaucaacggcacgugcgccguggucaucaccgacggguccgccagcggcaaggcggacaccaagauccuguucaucgaggagggcaagaucgugcacaccagcaagcucuccgggagcgcccagcacguggaggagugcuccugcuacccccgcuacccgggcauccggugcgucugccgcgacaacuggaaggggagcaaccggcccaucguggacaucaacaucaaggacuacuccaucgugagcuccuacgucugcagcggccuggugggcgacacgccccgcaagaacgacuccagcuccagcucccugugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaacccgaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggacguccaacagcaucguggucuucugcggcaccuccgggaccuacggcaccgggagcuggcccgacggcgccgacaucaaccugaugcccaucuga

SEQ ID NO: 75463 - RNA, 1410 nt, Artificial Sequence
  derived and/or modified sequence opt1 from neuraminidase__InfluenzaA__ABB02861
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacgagaacgccaccgccuccuucaucuacgacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucgucaacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucgaccugaugcccaucuga

SEQ ID NO: 75464 - RNA, 1410 nt, Artificial Sequence; identical to SEQ ID NO: 75261
  derived and/or modified sequence opt1 from neuraminidase__InfluenzaA__ABB02872

SEQ ID NO: 75465 - RNA, 1410 nt, Artificial Sequence; identical to SEQ ID NO: 75261
  derived and/or modified sequence opt1 from neuraminidase__InfluenzaA__ABB02883

SEQ ID NO: 75466 - RNA, 1410 nt, Artificial Sequence
  derived and/or modified sequence opt1 from neuraminidase__InfluenzaA__ABB02894
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagauggucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcaccagcgggaccuacggcacgggguccuggccggacggcgccgacaucaaccugaugcccaucuga

SEQ ID NO: 75467 - RNA, 1410 nt, Artificial Sequence; identical to SEQ ID NO: 75069
  derived and/or modified sequence opt1 from neuraminidase__InfluenzaA__ABB02905

SEQ ID NO: 75468 - RNA, 1413 nt, Artificial Sequence
  derived and/or modified sequence opt1 from neuraminidase__InfluenzaA__ABB02916
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcagauccugcgcacccaggagagcgagugcgugugcgugaacggcuccugcuucaccaucaugacggacggccccagcaacggggccgccuccuacaagaucuucaagaucgagaagggcaaggucaccaagagcaucgagcucaacgcccccaacuuccacuacgaggagugcuccugcuacccggacaccgggaccgugaugugcgugugccgggacaacuggcacggcagcaaccgccccugggucuccuucaaccagaaccuggacuaccagaucggguacaucugcagcggcguguucggcgacaacccccggccccgcgacggggagggcuccugcaacccggugacggucgacggggcgaacggcgugaagggguucagcuacaaguacggcaacggcguguggaucgggcggaccaaguccaaccgccugcggaagggcuucgagaugaucugggaccccaacggguggaccgacaccgacagcgacuucuccgucaagcaggacgugguggccaucacggacuggagcggcuacagcggguccuucguccagcaccccgagcucaccggccuggacugcauccgccccugcuucuggguggagcugguccggggccucccgcgcgagaacaccaccaucuggacgagcggguccagcaucuccuucugcggcgugaacagcgacaccgccaacugguccuggcccgacggggccgagcugcccuucaccaucgacaaguga

SEQ ID NO: 75469 - RNA, 1413 nt, Artificial Sequence
  derived and/or modified sequence opt1 from neuraminidase__InfluenzaA__ABB02927
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgcgggagaacaccaccaucuggacgagcggcuccagcaucuccuucugcggggugaacagcgacaccgccaacugguccuggcccgacggcgccgagcugcccuucaccaucgacaaguga

SEQ ID NO: 75470 - RNA, 1413 nt, Artificial Sequence
  derived and/or modified sequence opt1 from neuraminidase__InfluenzaA__ABB02939
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccuggaugaaccacaccuacgucaacaucaacaacacgaacgugaucgcggggaaggacaagaccagcgugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccgucgccuggagcgccuccgccugccacgacggcaugggcuggcucaccaucgggaucagcggccccgacaacggggcgguggccgugcugaaguacaacggcaucaucacggagaccaucaaguccuggaagaagcagauccugcgcacccaggagagcgagugcgucugcgugaacggcuccugcuucaccaucaugacggacgggcccagcaacggcgccgccuccuacaagaucuucaagaucgagaaggggaaggugaccaagagcauggagcucaacgcccccaacuuccacuacgaggagugcuccugcuacccggacaccggcaccgucaugugcgugugccgggacaacuggcacgggagcaaccgccccuggguguccuucaaccagaaccuggacuaccagaucggcuacaucugcagcggcgucuucggggacaacccccggcccaaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccgacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgaaggagaacaccaccaucuggacgagcggcuccagcaucuccuucugcggggucaacagcgacaccgccaacugguccuggcccgacggcgccgagcugcccuucaccaucgacaaguga

SEQ ID NO: 75471 - RNA, 1410 nt, Artificial Sequence; identical to SEQ ID NO: 75386
  derived and/or modified sequence opt1 from neuraminidase__InfluenzaA__ABB02950

SEQ ID NO: 75472 - RNA, 1410 nt, Artificial Sequence; identical to SEQ ID NO: 75287
  derived and/or modified sequence opt1 from neuraminidase__InfluenzaA__ABB02961

SEQ ID NO: 75473 - RNA, 1410 nt, Artificial Sequence; identical to SEQ ID NO: 75287
  derived and/or modified sequence opt1 from neuraminidase__InfluenzaA__ABB02972

SEQ ID NO: 75474 - RNA, 1410 nt, Artificial Sequence; identical to SEQ ID NO: 75287
  derived and/or modified sequence opt1 from neuraminidase__InfluenzaA__ABB02983

SEQ ID NO: 75475 - RNA, 1410 nt, Artificial Sequence; identical to SEQ ID NO: 75287
  derived and/or modified sequence opt1 from neuraminidase__InfluenzaA__ABB02994

SEQ ID NO: 75476 - RNA, 1410 nt, Artificial Sequence; identical to SEQ ID NO: 75287
  derived and/or modified sequence opt1 from neuraminidase__InfluenzaA__ABB03005

SEQ ID NO: 75477 - RNA, 1410 nt, Artificial Sequence; identical to SEQ ID NO: 75292
  derived and/or modified sequence opt1 from neuraminidase__InfluenzaA__ABB03016

SEQ ID NO: 75478 - RNA, 1410 nt, Artificial Sequence; identical to SEQ ID NO: 75287
  derived and/or modified sequence opt1 from neuraminidase__InfluenzaA__ABB03027

SEQ ID NO: 75479 - RNA, 1410 nt, Artificial Sequence; identical to SEQ ID NO: 75292
  derived and/or modified sequence opt1 from neuraminidase__InfluenzaA__ABB03038

SEQ ID NO: 75480 - RNA, 1410 nt, Artificial Sequence; identical to SEQ ID NO: 75287
  derived and/or modified sequence opt1 from neuraminidase__InfluenzaA__ABB03049

SEQ ID NO: 75481 - RNA, 1410 nt, Artificial Sequence
  derived and/or modified sequence opt1 from neuraminidase__InfluenzaA__ABB03060
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcauccggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 75482 - RNA, 1410 nt, Artificial Sequence
  derived and/or modified sequence opt1 from neuraminidase__InfluenzaA__ABB03071
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgggaucaccggcuucgcgcccuucuccaaggacaacagcauccgccuguccgccgggggcgacaucugggucacccgggagcccuacgugagcugcgaccccgacaagugcuaccaguucgcccucgggcagggcaccacgcugaacaacgugcacuccaacgacaccguccacgaccgcaccccguaccggacccugcucaugaacgagcugggcgugcccuuccaccuggggacgaagcaggucugcaucgccuggagcuccagcuccugccacgacggcaaggccuggcuccacgugugcgugaccggggacgacaagaacgcgaccgccagcuucaucuacaacggccgccugguggacuccaucgucagcugguccaaggagauccugcggacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgcuaccccgggguccggugcgugugccgcgacaacuggaagggcagcaaccggccgaucguggacaucaacaucaaggacuacuccaucgucagcuccuacgugugcagcggccuggugggggacacgccccgcaagaacgacuccagcuccagcucccacugccucgaccccaacaacgaggagggcgggcacggcgucaaggggugggccuucgacgacggcaacgacguguggaugggccggaccaucagcgagaagcugcgcuccggguacgagaccuucaaggucaucgagggcuggagcaaccccaacuccaagcugcagaucaaccgccaggugaucguggacaaggggaaccggagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 75483 - RNA, 1410 nt, Artificial Sequence
  derived and/or modified sequence opt1 from neuraminidase__InfluenzaA__ABB03093
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacaucgaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 75484 - RNA, 1410 nt, Artificial Sequence; identical to SEQ ID NO: 75390
  derived and/or modified sequence opt1 from neuraminidase__InfluenzaA__ABB03104

SEQ ID NO: 75485 - RNA, 1410 nt, Artificial Sequence
  derived and/or modified sequence opt1 from neuraminidase__InfluenzaA__ABB03115
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaacgaggugcuguggaccuccaacagcaucgucguguucugcggcaccuccgggaccuacggcacggggagcuggccggacggcgccgacaucaaccugaugcccaucuga

SEQ ID NO: 75486 - RNA, 1413 nt, Artificial Sequence; identical to SEQ ID NO: 75394
  derived and/or modified sequence opt1 from neuraminidase__InfluenzaA__ABB03126

SEQ ID NO: 75487 - RNA, 1413 nt, Artificial Sequence
  derived and/or modified sequence opt1 from neuraminidase__InfluenzaA__ABB03148
augaaccccaaccagaagaucaucaccaucggcagcaucuccaucgccaucgggaccaucagccugaugcuccagaucggcaacaucaucuccaucugggccagccacuccauccagacggggagccagaaccacaccggcaucugcaaccagcgcaucaucaccuacgagaacuccaccugggugaaccacacguacgucaacaucaacaacaccaacgugguggcggggaaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccgagaccaucaaguccuggaagaagcgcauccugcggacccaggagagcgagugcgugugcgugaacggcuccugcuucacgaucaugaccgacgggcccagcaacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugaccgucgacggcgcggacggggugaagggcuucagcuacaaguacggcaacgggguguggaucggccggaccaaguccaaccgccugcggaagggguucgagaugaucugggaccccaacggcuggaccgacacggacagcgacuucuccgucaagcaggacgugguggccaucaccgacuggagcggguacagcggcuccuucguccagcaccccgagcucaccggccuggacugcauccgccccugcuucuggguggagcugguccgggggcucccgcgcgagaacaccacgaucuggaccagcggcuccagcaucuccuucugcgggguggacagcgacaccgccaacugguccuggcccgacggcgccgagcugcccuucaccaucgacaaguga

SEQ ID NO: 75488 - RNA, 1410 nt, Artificial Sequence
  derived and/or modified sequence opt1 from neuraminidase__InfluenzaA__ABB04286
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacgccccaccggacccugcucaugaacgagcugggcgugcccuuccaccuggggacccgccaggugugcaucgccuggagcuccagcuccugccacgacggcaaggccuggcuccacgucugcgugaccggguacgacaagaacgcgaccgccagcuucaucuacgacggccggcugguggacuccaucgggagcugguccaagaacauccugcgcacccaggagagcgagugcgucugcaucaacgggaccugcacgguggugaugaccgacggcuccgccagcgagcgggccgacaccaagauccucuucaucgaggagggcaagaucguccacaucagcccccuguccggcagcgcgcagcacguggaggagugcuccugcuacccgcgcuaccccggggugcggugcgucugccgcgacaacuggaagggcagcaaccggcccgugguggacaucaacgucaaggacuacuccaucgugagcuccuacgugugcagcggccuggucggggacacgccccgcaagaacgaccgguccagcuccagcuacugccgcaacccgaacaacgagaagggcaaccacggggugaagggcugggccuucgacgacgggaacgacgucuggaugggccggaccaucuccgaggagagccgcuccggcuacgagaccuucaaggugaucgggggcuggagcacccccaacuccaagagccagaucaaccgccaggugaucgucgacuccgggaaccggagcggcuacagcgggaucuucuccguggagggcaagagcugcaucaaccggugcuucuacguggagcucauccgcggccgcgagcaggagacccgggucugguggacguccaacagcaucgugguguucugcgggaccuccggcaccuacgggaccggcagcuggcccgacggggccgacaucaaccugaugcccaucuga

SEQ ID NO: 75489 - RNA, 1410 nt, Artificial Sequence
  derived and/or modified sequence opt1 from neuraminidase__InfluenzaA__ABB04297
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugauccccugcgagcccaucacgaucgagcgcaacaucaccgagaucgucuaccucaccaacaccacgaucgagaaggagaucugccccaagcugguggaguaccggaacugguccaagccgcagugcaagaucaccggguucgcccccuucagcaaggacaacuccauccgccugagcgccggcggggacaucugggugacccgggagcccuacgucuccugcgaccccggcaagugcuaccaguucgcccucgggcagggcaccacgcuggacaacaagcacagcaacgacaccauccacgaccgcaccccgcaccggacccugcucaugaacgagcugggcgugcccuuccaccuggggacgcgccaggugugcaucgccugguccagcuccagcugccacgacggcaaggcguggcuccacgucugcgugaccggguacgacaagaacgccaccgccuccuucaucuacgacggccggcugguggacagcaucggguccuggagccagaacauccugcgcacccaggaguccgagugcgucugcaucaacggcacgugcaccguggugaugaccgacggcagcgccuccgggcgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccaacagcuacugccgcaaccccaacaacgagaaggggaaccacggcgugaaggggugggccuucgacgacggcaacgacgucuggaugggccggaccaucuccgaggacagccgcuccggguacgagaccuucaaggugaucggcggguggagcaccccgaacuccaagcuccagaucaaccggcaggucaucguggacagcgacaaccgcuccggcuacagcgggaucuucuccguggagggcaagagcugcaucaaccggugcuucuacgucgagcugauccgcggccgcgagcaggagacgcgggugugguggaccagcaacuccaucguggucuucugcgggaccagcggcaccuacgggacgggcuccuggcccgacggggccgacaucaaccugaugcccaucuga

SEQ ID NO: 75490 - RNA, 1410 nt, Artificial Sequence
  derived and/or modified sequence opt1 from neuraminidase__InfluenzaA__ABB04319
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacaagaacgcgaccgccagcuucaucuacaacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgaccgguccagcuccagcuacugccagaacccgaacaacgagaagggcucccacggggugaagggcugggccuucgacgacgggaacgacgucuggaugggccgcaccaucggcgaggagcuccggagcggguacgagaccuucaaggugaucggcgggugguccacccccaacagcaagcugcagaucaaccgccaggugaucgucgacuccggcaaccggagcggguacuccggcaucuucagcguggagggcaagagcugcaucaaccgcugcuucuacguggagcugauccgggggcgcaagcaggagacgcgcgucugguggaccuccaacagcaucgugguguucugcggcaccuccgggaccuacggcacggggagcuggcccgacggcgccgacaucaaccucaugcccaucuga

SEQ ID NO: 75491 - RNA, 1410 nt, Artificial Sequence
  derived and/or modified sequence opt1 from neuraminidase__InfluenzaA__ABB04341
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccgugcgccugagcgccggcggggacaucugggucacccgggagcccuacguguccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggucugcaucgccugguccagcuccagcugccacgacggcaaggcguggcuccacgugugcgugacgggguacgacaagaacgccaccgccuccuucaucuacgacggccggcuggucgacagcaucggguccuggagccagaacauccugcgcacccaggaguccgagugcgugugcaucaacgggaccugcacgguggucaugaccgacggcagcgccuccggccgggcggacaccaagauccucuucaucgaggagggcaagaucgugcacaucagcccccugagcggguccgcccagcacguggaggagugcagcugcuacccccgcuacccgggcguccggugcaucugccgcgacaacuggaagggcuccaaccggcccgugguggacaucaacgucaaggacuacagcaucgacuccagcuacgugugcuccgggcuggugggcgacacgccccgcaagaacgaccggagcuccaacagcuacugccgcaaccccaacaacgagaaggggaaccacggcgucaaggggugggccuucgacgacggcaacgacguguggaugggccggaccaucuccgaggacagccgcuccggguacgagaccuucaaggucaucggcggguggagcaccccgaacuccaagcuccagaucaaccgccaggugaucguggacagcgacaaccgguccggcuacagcgggaucuucuccgucgagggcaagagcugcaucaaccggugcuucuacguggagcugauccgcggccgcgagcaggagacccgggugugguggacgagcaacuccaucgucguguucugcgggaccagcggcaccuacgggaccggcuccuggcccgacggggccgacaucaaccugaugcccaucuga

SEQ ID NO: 75492 - RNA, 1410 nt, Artificial Sequence
  derived and/or modified sequence opt1 from neuraminidase__InfluenzaA__ABB04352
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccugaacaacaagcacuccaacgacacggugcacgaccgcacccccuaccggacccugcucaugaacgagcugggcgugcccuuccaccuggggaccaagcaggucugcaucgccuggagcuccagcuccugccacgacggcaaggccuggcuccacgugugcgugacggggcacgacaagaacgcgaccgccagcuucaucuacgacggccgccuggucgacuccaucgggagcugguccaagaacauccugcggacccaggagagcgagugcgugugcaucaacgggaccugcacgguggucaugaccgacggcuccgccagcgagcgcgccgacaccaagauccucuucaucgaggagggcaagaucgugcacaucagcccccuguccggcagcgcgcagcacguggaggagugcuccugcuacccgcgguaccccgggguccgcugcgugugccgggacaacuggaagggcagcaaccgccccaucguggacaucaacgucaaggacuacuccaucgugagcuccuacgugugcagcggccuggucggggacacgccccggaagaacgaccgcuccagcuccagcuacugccggaacccgaacaacgagaagggcucccacggggugaagggcugggccuucgacgacgggaacgacgucuggaugggccgcaccaucggcgaggagcuccggagcggguacgagaccuucaaggugaucggcgggugguccacccccaacagcaagcugcagaucaaccgccaggugaucgucgacuccggcaaccggagcggguacuccggcaucuucagcguggagggcaagagcugcaucaaccgcugcuucuacguggagcugauccgggggcgcgagcaggagacccgcgucugguggacguccaacagcaucgugguguucugcggcaccuccgggaccuacggcaccgggagcuggcccgacggcgccgacaucaaccucaugcccaucuga
